US012435140B2

(12) United States Patent
Friedman et al.

(10) Patent No.: US 12,435,140 B2
(45) Date of Patent: Oct. 7, 2025

(54) ANTIGEN BINDING POLYPEPTIDES

(71) Applicant: Kelonia Therapeutics, Inc., Boston, MA (US)

(72) Inventors: Kevin M. Friedman, Boston, MA (US); Molly R. Perkins, Milton, MA (US); Connor S. Dobson, Washington, DC (US); Stephen L. Sazinsky, Winchester, MA (US); Shannon G. Contrastano, Auburndale, MA (US); Emily Thompson Beura, Mansfield, MA (US); Cory Ahonen, Lebanon, NH (US); Andrew Avery, Lebanon, NH (US)

(73) Assignee: Kelonia Therapeutics, Inc., Boston, MA (US)

( * ) Notice: Subject to any disclaimer, the term of this patent is extended or adjusted under 35 U.S.C. 154(b) by 0 days.

(21) Appl. No.: 19/172,374

(22) Filed: Apr. 7, 2025

(65) Prior Publication Data

US 2025/0236672 A1 Jul. 24, 2025

Related U.S. Application Data

(63) Continuation of application No. 18/919,069, filed on Oct. 17, 2024, now Pat. No. 12,269,882, which is a continuation of application No. PCT/US2024/048295, filed on Sep. 25, 2024.

(60) Provisional application No. 63/618,880, filed on Jan. 8, 2024, provisional application No. 63/540,332, filed on Sep. 25, 2023.

(51) Int. Cl.

*C07K 16/28* (2006.01)
*C07K 14/705* (2006.01)
*C07K 14/725* (2006.01)
*C12N 15/86* (2006.01)

(52) U.S. Cl.

CPC ...... *C07K 16/2809* (2013.01); *C07K 14/7051* (2013.01); *C07K 14/70517* (2013.01); *C07K 14/70578* (2013.01); *C07K 16/2878* (2013.01); *C12N 15/86* (2013.01); *C07K 2317/31* (2013.01); *C07K 2317/53* (2013.01); *C07K 2317/565* (2013.01); *C07K 2317/622* (2013.01); *C07K 2319/02* (2013.01); *C07K 2319/03* (2013.01); *C12N 2740/15043* (2013.01); *C12N 2830/50* (2013.01)

(58) Field of Classification Search

CPC ............ C07K 16/2809; C07K 14/7051; C07K 14/70517; C07K 14/70578; C07K 16/2878; C07K 2317/31; C07K 2317/53; C07K 2317/565; C07K 2317/622; C07K 2319/02; C07K 2319/03; C12N 15/86; C12N 2740/15043; C12N 2830/50

See application file for complete search history.

(56) References Cited

U.S. PATENT DOCUMENTS

| | | | |
|---|---|---|---|
| 7,901,671 | B2 | 3/2011 | Leboulch et al. |
| 9,994,867 | B2 | 6/2018 | Baltimore et al. |
| 11,767,366 | B1 | 9/2023 | Russell et al. |
| 12,030,915 | B2 | 7/2024 | Albertini et al. |
| 12,061,187 | B2 | 8/2024 | Birnbaum et al. |
| 12,061,188 | B2 | 8/2024 | Birnbaum et al. |
| 12,091,434 | B2 | 9/2024 | Albertini et al. |
| 12,222,347 | B2 | 2/2025 | Birnbaum et al. |
| 12,264,180 | B2 | 4/2025 | Albertini et al. |
| 12,269,848 | B2 | 4/2025 | Albertini et al. |
| 12,269,882 | B1 | 4/2025 | Friedman et al. |
| 12,291,551 | B2 | 5/2025 | Albertini et al. |
| 12,297,237 | B2 | 5/2025 | Albertini et al. |
| 12,312,593 | B2 | 5/2025 | Perkins et al. |
| 2008/0124357 | A1 | 5/2008 | Yao et al. |
| 2008/0241929 | A1 | 10/2008 | Naldini et al. |
| 2014/0017766 | A1 | 1/2014 | Chen et al. |
| 2015/0182617 | A1 | 7/2015 | Bauche et al. |
| 2015/0316511 | A1 | 11/2015 | Guo |
| 2016/0333374 | A1 | 11/2016 | Anastasov et al. |
| 2017/0051252 | A1 | 2/2017 | Morgan et al. |
| 2017/0137783 | A1 | 5/2017 | Bedoya et al. |
| 2017/0176435 | A1 | 6/2017 | Seidell, III et al. |
| 2017/0192011 | A1 | 7/2017 | Birnbaum et al. |
| 2017/0240631 | A1 | 8/2017 | Monroe et al. |
| 2017/0356010 | A1 | 12/2017 | Frost et al. |
| 2018/0155425 | A1 | 6/2018 | Ma et al. |
| 2018/0201954 | A1 | 7/2018 | Buchholz et al. |

(Continued)

FOREIGN PATENT DOCUMENTS

| | | | |
|---|---|---|---|
| CA | 2344208 | A1 | 10/2002 |
| CN | 1643164 | A | 7/2005 |

(Continued)

OTHER PUBLICATIONS

Albertini, et al., "Molecular and Cellular Aspects of Rhabdovirus Entry," Viruses, 4:117-139 (2012).

(Continued)

*Primary Examiner* — Julie Wu
*Assistant Examiner* — Amber K Faust
(74) *Attorney, Agent, or Firm* — Morse, Barnes-Brown & Pendleton, P.C.; Lisa M. Warren, Esq.; Erin E. Bryan, Esq.

(57) ABSTRACT

The present disclosure provides compositions comprising antigen binding polypeptides. More particularly, the disclosure relates to polypeptides comprising antibodies or antigen binding fragments thereof, nucleic acids encoding the polypeptides, and vectors for expressing the same.

30 Claims, 20 Drawing Sheets
(6 of 20 Drawing Sheet(s) Filed in Color)
Specification includes a Sequence Listing.

(56) References Cited

U.S. PATENT DOCUMENTS

| | | | |
|---|---|---|---|
| 2018/0362966 A1 | 12/2018 | Flechtner et al. | |
| 2019/0144885 A1 | 5/2019 | Costa Fejoz et al. | |
| 2019/0161530 A1 | 5/2019 | Certo et al. | |
| 2020/0023010 A1 | 1/2020 | DiLillo et al. | |
| 2020/0216502 A1 | 7/2020 | Albertini et al. | |
| 2020/0277629 A1 | 9/2020 | Cawood et al. | |
| 2020/0339699 A1 | 10/2020 | Li et al. | |
| 2020/0368370 A1 | 11/2020 | Leboulch et al. | |
| 2020/0371088 A1 | 11/2020 | Birnbaum et al. | |
| 2021/0128619 A1 | 5/2021 | Campbell et al. | |
| 2021/0137977 A1 | 5/2021 | Chaudhary | |
| 2021/0324100 A1 | 10/2021 | Sather et al. | |
| 2022/0204946 A1 | 6/2022 | Antunes et al. | |
| 2022/0340876 A1 | 10/2022 | Birnbaum et al. | |
| 2023/0051847 A1 | 2/2023 | Vogelstein et al. | |
| 2023/0159651 A1* | 5/2023 | Zhao .................. | C07K 16/2878 424/144.1 |
| 2023/0167158 A1 | 6/2023 | Najjar et al. | |
| 2023/0279363 A1 | 9/2023 | Russell et al. | |
| 2024/0044873 A1 | 2/2024 | Birnbaum et al. | |
| 2024/0092839 A1 | 3/2024 | Albertini et al. | |
| 2024/0150788 A1 | 5/2024 | Perkins et al. | |
| 2024/0218390 A1 | 7/2024 | Perkins et al. | |
| 2024/0230627 A1 | 7/2024 | Birnbaum et al. | |
| 2024/0317811 A1 | 9/2024 | Albertini et al. | |
| 2024/0317812 A1 | 9/2024 | Albertini et al. | |
| 2024/0327466 A1 | 10/2024 | Albertini et al. | |
| 2024/0327467 A1 | 10/2024 | Albertini et al. | |
| 2025/0099587 A1 | 3/2025 | Friedman et al. | |
| 2025/0099615 A1 | 3/2025 | Friedman et al. | |
| 2025/0101106 A1 | 3/2025 | Friedman et al. | |
| 2025/0101122 A1 | 3/2025 | Friedman et al. | |
| 2025/0147007 A1 | 5/2025 | Birnbaum et al. | |
| 2025/0171504 A1 | 5/2025 | Albertini et al. | |
| 2025/0171505 A1 | 5/2025 | Albertini et al. | |

FOREIGN PATENT DOCUMENTS

| | | |
|---|---|---|
| CN | 108040484 A | 5/2018 |
| CN | 115322257 A | 11/2022 |
| EP | 1461079 B1 | 8/2011 |
| WO | WO-2001/19380 A2 | 3/2001 |
| WO | WO-2008/037458 A2 | 4/2008 |
| WO | WO-2009/013324 A1 | 1/2009 |
| WO | WO-2012/088381 A2 | 6/2012 |
| WO | WO-2015/104376 A1 | 7/2015 |
| WO | WO-2015/112541 A2 | 7/2015 |
| WO | WO-2015/117027 A1 | 8/2015 |
| WO | WO-2016/139463 A1 | 9/2016 |
| WO | WO-2017/182585 A1 | 10/2017 |
| WO | WO-2019/056015 A2 | 3/2019 |
| WO | WO-2019/057974 A1 | 3/2019 |
| WO | WO-2020/123936 A1 | 6/2020 |
| WO | WO-2020/236263 A1 | 11/2020 |
| WO | WO-2022/013872 A1 | 1/2022 |
| WO | WO-2022/183072 A1 | 9/2022 |
| WO | WO-2022/221745 A1 | 10/2022 |
| WO | WO-2025/038475 A1 | 2/2025 |
| WO | 2025/072253 A1 | 4/2025 |
| WO | 2025/072257 A1 | 4/2025 |

OTHER PUBLICATIONS

Altschul, et al., "Basic Local Alignment Search Tool," J Mol Biol. (3):403-10 (1990).

Altschul, et al., "Gapped BLAST and PSI-BLAST: A New Generation of Protein Database Search Programs," Nucleic Acids Res, 25(17):3389-402 (1997).

Amirache, et al., "Mystery Solved: VSV-G-LVs Do Not Allow Efficient Gene Transfer into Unstimulated T Cells, B Cells, and HSCs Because They Lack the LDL Receptor," Blood, 123: 1422-1424 (2014).

Ammayappan, et al., "Characteristics of Oncolytic Vesicular Stomatitis Virus Displaying Tumor-Targeting Ligands," Journal of Virology vol. 87(24):13543-13555 (2013).

An, X., "Preliminary Study on HBV and HIV seudovirus Vector Systems," China Master's Thesis Full-text Database, Basic Science Collection: 1-121 (2007).

Barber, G.N., "VSV-tumor Selective Replication and Protein Translation," Oncogene 24: 7710-7719 (2005).

Baroja, et al., "Specific CD3 epsilon association of a phosphodiesterase 4B isoform determines its selective tyrosine phosphorylation after CD3 ligation," Journal of Immunology, 162(4):2016-23, 1999.

Bentzen, et al., "Evolution of MHC-based Technologies Used for Detection of Antigen-responsive T Cells," Cancer Immunol Immunother, 66:657-66 (2017).

Bowie, J., et al., "Deciphering the Message in Protein Sequences: Tolerance to Amino Acid Substitutions," Science, 247(4948):1306-10 (1990).

Buchholz, et al., "Retroviral Display and High Throughput Screening," Comb Chem High Throughput Screen, 11 (2):99-110 (2008).

Chan, L., et al., "Conjugation of Lentivirus to Paramagnetic Particles via Nonviral Proteins Allows Efficient Concentration and Infection of Primary Acute Myeloid Leukemia Cells," J. of Virology, 79(20):13190-13194 (2005).

Chen, Z., et al., "Human Monoclonal Antibodies Targeting the Haemagglutinin Glycoprotein can Neutralize H7N9 Influenza Virus," Nat Commun, 6:6714 (2015).

Cire, S, "Immunization of Mice with Lentiviral Vectors Targeted to MHC Class II+ Cells is Due to Preferential Transduction of Dendritic Cells in vivo," PLoS One, 9(7):e101644, (2014).

Dobson, et al., "Antigen Identification and High-throughput Interaction Mapping by Reprogramming Viral Entry," Nature Method, 19(4):449-460 (2022).

Dreja, H., et al., "The Effects of N-terminal Insertion into VSV-G of an scFv Peptide," Viral J, 3:69, 1186 (2006).

Ferlin, et al., "Characterization of pH-sensitive Molecular Switches that Trigger the Structural Transition of Vesicular Stomatitis Virus Glycoprotein from the Postfusion State Toward the Prefusion State," J Virol, 88:13396-13409 (2014).

Finkelshtein, et al., "LDL Receptor and its Family Members Serve as the Cellular Receptors for Vesicular Stomatitis Virus," PNAS, 110(18):7306-7311 (2013).

Frank, A., et al., "Surface-Engineered Lentiviral Vectors for Selective Gene Transfer into Subtypes of Lymphocytes," Mol Ther Methods Clin Dev, 12:19-31 (2018).

Froelich, et al., "Targeted Gene Delivery to CD117-expressing Cells in vivo with Lentiviral Vectors Co-displaying Stem Cell Factor and a Fusogenic Molecule,", Biotechnology and Bioengineering, 104(1):206-215 (2009).

Funke, et al., Targeted Cell Entry of Lentiviral Vectors,: Mol Ther. I6(8):1427-36 (2008).

Goyvaerts, C., et al., "Development of the Nanobody Display Technology to Target Lentiviral Vectors to Antigen-Presenting Cells," Gene Therapy, 19:1133-1140 (2012).

Grubaugh, et al., "Proteins as T Cell Antigens: Methods for High-throughput Identification," Vaccine 31(37) (2013).

Guideng, et al., "T Cell Antigen Discovery Via Trogocytosis," Nature Methods, 16(2):183-90 (2019).

Hastie, E, et al., "Understanding and Altering Cell Tropism of Vesicular Stomatitis Virus," Virus Res. 176(1-2):16-32 (2013).

He, et al., "Can Immunotherapy Reinforce Chemotherapy Efficacy? A New Perspective on Colorectal Cancer Treatment," Front. Immunol. 14:1237764 (2023).

Höfig, I., et al., "Systematic Improvement of Lentivirus Transduction Protocols by Antibody Fragments Fused to VSV-G as Envelope Glycoprotein," Biomaterials, 35(13):4204-12 (2014).

Humes, D., "The TOP Vector: a New High-titer Lentiviral Construct for Delivery of sgRNAs and Transgenes to Primary T Cells," Molecular Therapy Methods & Clinical Development, 20:30-38 (2021).

International Search Report from International Application No. PCT/US2020/024175, date mailed: Sep. 14, 2020.

International Search Report from International Application No. PCT/US2022/018027, dated mailed: Jun. 21, 2022.

(56) References Cited

OTHER PUBLICATIONS

International Search Report in International Application No. PCT/EP2018/075824, dated: Nov. 28, 2018.
International Search Report in International Application No. PCT/US2022/025142, dated: Apr. 10, 2022.
International Search Report in International Application No. PCT/US2024/048295, dated: Jan. 10, 2025.
International Search Report in International Application No. PCT/US2024/048301, dated: Jan. 16, 2025.
International Search Report in International Application No. PCT/US2024/041779, dated: Dec. 20, 2024.
Joglekar, et al., "T Cell Antigen Discovery via Signaling and Antigen-presenting Bifunctional Receptors," Nature Methods, 16(2):191-8 (2019).
Kameyama, Y., et al., "Antibody-dependent Gene Transduction using Gammaretroviral and Lentiviral Vectors Pseudotyped with Chimeric Vesicular Stomatitis Virus Glycoprotein," J Viral Methods, 153(1 ):49-54 (2008).
Karlin, et al., "Applications and Statistics for Multiple High-scoring Segments in Molecular Sequences," Proc Natl Acad Sci US A, 90(12):5873-7 (1993).
Karlin, et al., "Methods for Assessing the Statistical Significance of Molecular Sequence Features by Using General Scoring Schemes," Proc Natl Acad Sci US A., 87(6):2264-8 (1998).
Kussie, P., et al., "A Single Engineered Amino Acid Substitution Changes Antibody Fine Specificity," J Immunol, 152(1):146-52. (1994).
Labbe, R., et al., "Lentiviral Vectors for T Cell Engineering: Clinical Applications, Bioprocessing and Future Perspectives," Viruses 13(1528): 1-22 (2021).
Milani, M., et al., "Genome Editing for Scalable Production of Alloantigen-free Lentiviral Vectors for in vivo Gene Therapy," EMBO Mol Med, 9(11):1558-1573 (2017).
Nikolic, J., et al., "Structural Basis for the Recognition of LDL-receptor Family Members by VSV Glycoprotein," Nat Commun, 9(1):1029 (2018).
Non-Final Office Action for U.S. Appl. No. 18/919,103, dated Feb. 6, 2025.
Non-Final Office Action in U.S. Appl. No. 18/919,082, dated: Mar. 26, 2025.
Notice of Allowance in U.S. Appl. No. 18/919,069, dated: Jan. 16, 2025.
Ou, W, et al., "Specific Targeting of Human Interleukin (IL)-13 Receptor A2-positive Cells with Lentiviral Vectors Dsplaying IL-13," Hum Gene Ther Methods, 2:137-47, (2012).
Patent Owner's Preliminary Response with Exhibit 2001, of U.S. Pat. No. 11,767,366, Before the Patent Trial and Appeal Board, *Kelonia Theraptutics, Inc.* Petitioner, v. *Interius Biotherapeutics, Inc.*, Patent Owner, Case No. PGR2024-00008, 95 Pages.
Patent Owner's Sur-Reply of U.S. Pat. No. 11,767,366, Before the Patent Trial and Appeal Board, *Kelonia Therapeutics, Inc.*, Petitioner v. *Interius Biotherapeutics, Inc.*, Patent Owner, Case No. PGR2024-0008, 6 pages.
Peach, et al., "Both Extracellular Immunoglobin-like Domains of CD80 Contain Residues Critical for Binding T Cell Surface Receptors CTLA-4 and CD28," J. Biol Chem, 270(36):21181-21187 (1995).
Petition for Post-Grant Review of U.S. Pat. No. 11,767,366, Before the Patent Trial and Appeal Board, *Kelonia Therapeutics, Inc.*, Petitioner v. *Interius Biotherapeutics, Inc.*, Patent Owner, 98 Pages.
Petitioner's Reply to Patent Owner's Preliminary Response of U.S. Pat. No. 11,767,366 Before the Patent Trial and Appeal Board, *Kelonia Therapeutics, Inc.*, Petitioner v. *Interius Biotherapeutics, Inc.*, Patent Owner, Case No. PGR2024-0008, 8 pages.
Roche, et al., "Crystal Structure of the Low-pH Form of the Vesicular Stomatitis Virus Glycoprotein," G. Science, 313: 187-191 (2006).
Roche, et al., "Structure of the Prefusion Form of the Vesicular Stomatitis Virus Glycoprotein G," Science 315: 843-848 (2007).
Schambach, A., et al., "Biosafety Features of Lentiviral Vectors," Human Gene Therapy, 24:132-142 (2013).
Sela-Culang, I., et al., "The Structural Basis of Antibody-Antigen Recognition," Front Immunol, 4:302 (2013).
Sevier, CS, et al, "Efficient Export of the Vesicular Stomatitis Virus G Protein from the Endoplasmic Reticulum Requires a Signal in the Cytoplasmic Tail that Includes both Tyrosine-based and Di-acidic Motifs," Mol Biol Cell. 1:13-22 (2000).
Sirin, S., et al., "AB-Bind: Antibody Binding Mutational Database for Computational Affinity Predictions," Protein Sci, 25(2):393-409 (2015).
Strausberg, et al., CD8a molecule [*Homo sapiens*], GenBank Association: AAH25715.1, Jul. 15, 2006, pp. 103, [retrieved Nov. 18, 2024]. Retrieved from the Internet <URL: https://www.ncbi.nlm.nih.gov/protein/AAH25715.1?report=genbank&log$=pros top &blastrank=6&RID=KRB38RWiJ013>. entire document.
Taube, et al., "Lentivirus Display: Stable Expression of Human Antibodies on the Surface of Human Cells and Virus Particles," PLoS One, 3(9):e3181 (2008).
Urban, et al., "Retroviral Display in Gene Therapy, Protein Engineering, and Vaccine Development," ACS Chem Biol., 6(1):61-74(2011).
Urban, et al., "Selection of Functional Human Antibodies from Retroviral Display Libraries," Nucleic Acids Res., 33(4):e35 (2005).
Winkler, K., et al., "Changing the Antigen Binding Specificity by Single Point Mutations of an Anti-p24 (HIV-1) Antibody," J Immunol, 165(8):4505-14 (2000).
Yang, et al., "Targeting Lentiviral Vectors to Specific Cell Types in vivo," PNAS, 103(31 ):114 79-84 (2006).
Yang, H., et al., "Cell Type-Specific Targeting with Surface-Engineered Lentiviral Vectors Co-displaying OKT3 Antibody and Fusogenic Molecule," Pharm Res, 26(6): 1432-45 (2009).
Yu, B., et al., "Engineered Cell Entry Links Receptor Biology with Single-cell Genomics," Cell, 185(26):4904-4920 (2022).
Zhang, et al., "Cell-specific Targeting of Lentiviral Vectors Mediated by Fusion Proteins Derived from Sindbis Virus, Vesicular Stomatitis Virus, or Avian Sarcoma/Leukosis Virus," Retrovirology, Biomed Central Ltd., 7(1):3 (2010).
Zhang, N., et al., "Leucine-rich Repeat-containing G Protein-coupled Receptor 4 Facilitates Vesicular Stomatitis Virus Infection by Binding Vesicular Stomatitis Virus Glycoprotein," J Biol Chem, 292(40):16527-16538 (2017).
Final Office Action in U.S. Appl. No. 18/375,868, dated Jan. 28, 2025.
Non-Final Office Action in U.S. Appl. No. 18/375,868, dated: Jun. 28, 2024.
Notice of Allowance in U.S. Appl. No. 18/375,868, dated Apr. 19, 2024.
Notice of Allowance for U.S. Appl. No. 18/375,868, dated Apr. 16, 2025.
Bjorkman, et al., "Mutations That Affect Ligand Binding to the *Escherichia coli* Aspartate Receptor," Journal of Biological Chemistry, 276(4):2808-2815, 2001.
Knopp, et al., "Transient Retrovirus-Based CRISPR/Cas9 All-in-One Particles for Efficient, Targeted Gene Knockout," Molecular Therapy: Nucleic Acids, vol. 13, Dec. 2018.
Lombardo, et al., "Gene editing in human stem cells using zinc finger nucleases and integrase-defective lentiviral vector delivery," Nature Biotechnology, vol. 25(11), Nov. 2007.
Agarwal, et al., "In Vivo Generation of CAR T Cells Selectively in Human CD4+ Lymphocytes," Molecular Therapy, 28(8), Aug. 2020.
Final Office Action in U.S. Appl. No. 18/919,103, dated May 21, 2025.
Mishra, et al., "CAR-T-Cell Therapy in Multiple Myeloma: B-Cell Maturation Antigen (BCMA) and Beyond," Vaccines, 11, 1721, 2023.
Nikolic, et al., "Structural basis for the recognition of LDL-receptor family members by VSV glycoprotein," Nature Communications, 9:1029, 2018 with attached Supplementary Information.
Non-Final Office Action for U.S. Appl. No. 18/279,201, dated Jun. 13, 2025.

(56) References Cited

OTHER PUBLICATIONS

Pinto, et al., "From ex vivo to in vivo chimeric antigen T cells manufacturing: new horizons for CAR T-cell based therapy," Journal of Translational Medicine, 23:10, 2025.
Short, et al., "Direct in vivo CAR T cell engineering," Trends in Pharmacological Sciences, 45(5), May 2024.
Ho, et al., "Decoupling the Functional Pleiotropy of Stem Cell Factor by Tuning c-Kit Signaling," Cell, 168(6):1041-1052, 2017.
Notice of Allowance for U.S. Appl. No. 18/919,082, dated: Jun. 24, 2025.

* cited by examiner

ANTIGEN BINDING POLYPEPTIDES

CROSS REFERENCE TO RELATED APPLICATIONS

This application is a continuation application of U.S. application Ser. No. 18/919,069, filed on Oct. 17, 2024, which is a continuation application of International Application No. PCT/US2024/048295, filed Sep. 25, 2024, which claims the benefit of and priority to U.S. Provisional Application No. 63/540,332, filed Sep. 25, 2023, and U.S. Provisional Application No. 63/618,880, filed Jan. 8, 2024. The entire teachings of the applications are incorporated herein by reference.

STATEMENT REGARDING SEQUENCE LISTING

The Sequence Listing associated with this application is provided in XML format in lieu of a paper copy and is hereby incorporated by reference into the specification. The name of the XML file containing the Sequence Listing is KELO-011-103X_ST26.xml. The XML file is 1,175,000 bytes KB, was created on May 29, 2025, and is being submitted electronically via Patent Center, concurrent with the filing of the specification.

TECHNICAL FIELD

The present disclosure relates to antigen binding polypeptides. More particularly, the disclosure relates to polypeptides comprising antibodies or antigen binding fragments thereof, nucleic acids encoding the polypeptides, and vectors for expressing the same.

DESCRIPTION OF THE RELATED ART

B cell maturation antigen (BCMA) is a member of the tumor necrosis factor receptor superfamily and is also known as tumor necrosis factor receptor superfamily member 17 (TNFRSF17). BCMA is normally expressed in mature B lymphocytes and plasma cells. BCMA expression is also detected in various lymphomas and multiple myelomas. Multiple myeloma is an incurable plasma cell malignancy that originates in the bone marrow.

Multiple myeloma is the second most prevalent hematological malignancy after non-lymphoma. In 2020, an estimated 176,404 people world-wide were diagnosed with multiple myeloma and about 117,077 patients succumbed to the disease. In 2023, an estimated 35,730 people in the United States alone will be diagnosed with multiple myeloma and an estimated 12,590 multiple myeloma patients will pass from the disease or associated complications. The 5-year relative survival rate for multiple myeloma in the United States is only about 58%

Multiple myeloma may initially be treated with an autologous stem cell transplantation (ASCT) and/or various drug combinations (e.g., proteasome inhibitors including bortezomib, carfilzomib, ixazomib; immunomodulatory drugs (IMiDs) including pomalidomide, lenalidomide, thalidomide; and corticosteroids like dexamethasone) but patients eventually relapse with the disease becoming refractory to treatment. Subsequent lines of treatment include monoclonal antibodies, bispecific antibodies, e.g., BiTEs, antibody-drug conjugates, and finally chimeric antigen receptor T cell therapy.

Autologous ex vivo chimeric antigen receptor (CAR) T cell therapy is emerging as a late line treatment for multiple myeloma patients. Although promising, these ex vivo CAR T cell therapies have yet to realize their potential because drug product manufacturing timelines are long and costly, because access to the therapies is limited to a few treatment centers with specialized expertise necessary to provide the therapies, because these therapies are associated with high rates of cytokine release syndrome, and because most patients eventually relapse and succumb to the disease. There remains a significant unmet need for multiple myeloma patients for more affordable, more accessible, and more efficacious therapies.

BRIEF SUMMARY

The present disclosure generally relates, in part, antibodies and antigen binding fragments thereof directed against B cell maturation antigen (BCMA), polypeptides comprising an anti-BCMA antibody or antigen binding fragment thereof, bispecific antibodies comprising an anti-BCMA antibody or antigen binding fragment thereof and an anti-CD3 antibody, immunoconjugates comprising an anti-BCMA antibody drug linked to a cytotoxic agent, and anti-BCMA chimeric antigen receptors, polynucleotides encoding the polypeptides, vectors for expressing the polynucleotides, and compositions comprising the foregoing.

In various embodiments, the disclosure contemplates, in part, an antibody or antigen binding fragment thereof comprising: (a) a heavy chain variable region (VH) comprising a CDRH1, a CDRH2, and a CDRH3 of an antibody or antigen binding fragment thereof set forth in Table 1; a polypeptide linker; and a light chain variable region (VL) comprising a CDRL1, a CDRL2, and a CDRL3 of an antibody or antigen binding fragment thereof set forth in Table 1; or (b) a VHH domain comprising a CDRH1, a CDRH2, and a CDRH3 of an antibody or antigen binding fragment thereof set forth in Table 1.

In particular embodiments: (a) the VH comprises a CDRH1, a CDRH2, and a CDRH3 comprising the amino acid sequences set forth in SEQ ID NOs: 12, 13, and 14 and the VL comprises a CDRL1, a CDRL2, and a CDRL3 comprising the amino acid sequences set forth in SEQ ID NOs: 16, 17, and 18; (b) the VH comprises a CDRH1, a CDRH2, and a CDRH3 comprising the amino acid sequences set forth in SEQ ID NOs: 22, 23, and 24 and the VL comprises a CDRL1, a CDRL2, and a CDRL3 comprising the amino acid sequences set forth in SEQ ID NOs: 26, 27, and 28; (c) the VH comprises a CDRH1, a CDRH2, and a CDRH3 comprising the amino acid sequences set forth in SEQ ID NOs: 32, 33, and 34 and the VL comprises a CDRL1, a CDRL2, and a CDRL3 comprising the amino acid sequences set forth in SEQ ID NOs: 36, 37, and 38; (d) the VH comprises a CDRH1, a CDRH2, and a CDRH3 comprising the amino acid sequences set forth in SEQ ID NOs: 42, 43, and 44 and the VL comprises a CDRL1, a CDRL2, and a CDRL3 comprising the amino acid sequences set forth in SEQ ID NOs: 46, 47, and 48; (e) the VH comprises a CDRH1, a CDRH2, and a CDRH3 comprising the amino acid sequences set forth in SEQ ID NOs: 52, 53, and 54 and the VL comprises a CDRL1, a CDRL2, and a CDRL3 comprising the amino acid sequences set forth in SEQ ID NOs: 56, 57, and 58; (f) the VH comprises a CDRH1, a CDRH2, and a CDRH3 comprising the amino acid sequences set forth in SEQ ID NOs: 62, 63, and 64 and the VL comprises a CDRL1, a CDRL2, and a CDRL3 comprising the amino acid sequences set forth in SEQ ID NOs: 66, 67, and 68; (g) the VH comprises a CDRH1, a CDRH2, and a CDRH3 comprising the amino acid sequences set forth in SEQ ID NOs: 72, 73, and 74 and the VL comprises a CDRL1, a CDRL2, and a CDRL3 comprising the amino acid sequences set forth in SEQ ID NOs: 76, 77, and 78; (h) the VH comprises a CDRH1, a CDRH2, and a CDRH3 comprising the amino acid sequences set forth in SEQ ID NOs: 82, 83, and 84 and the VL comprises a CDRL1, a CDRL2, and a CDRL3 comprising the amino acid sequences set forth in SEQ ID NOs: 86, 87, and 88; (i) the VH comprises a CDRH1, a CDRH2, and a CDRH3 comprising the amino acid sequences set forth in SEQ ID NOs: 92, 93, and 94 and the VL comprises a CDRL1, a CDRL2, and a CDRL3 comprising the amino acid sequences set forth in SEQ ID NOs: 96, 97, and 98; (j) the VHH domain comprises a CDRH1, a CDRH2, and a CDRH3 comprising the amino acid sequences set forth in SEQ ID NOS: 102, 103, and 104; (k) the VHH domain comprises a CDRH1, a CDRH2, and a CDRH3 comprising the amino acid sequences set forth in SEQ ID NOs: 106, 107, and 108; (1) the VHH domain comprises a CDRH1, a CDRH2, and a CDRH3 comprising the amino acid sequences set forth in SEQ ID NOs: 110, 111, and 112; (m) the VHH domain comprises a CDRH1, a CDRH2, and a CDRH3 comprising the amino acid sequences set forth in SEQ ID NOs: 114, 115, and 116; (n) the VHH domain comprises a CDRH1, a CDRH2, and a CDRH3 comprising the amino acid sequences set forth in SEQ ID NOs: 118, 119, and 120; (o) the VHH domain comprises a CDRH1, a CDRH2, and a CDRH3 comprising the amino acid sequences set forth in SEQ ID NOs: 122, 123, and 124; (p) the VHH domain comprises a CDRH1, a CDRH2, and a CDRH3 comprising the amino acid sequences set forth in SEQ ID NOs: 126, 127, and 128; (q) the VHH domain comprises a CDRH1, a CDRH2, and a CDRH3 comprising the amino acid sequences set forth in SEQ ID NOs: 130, 131, and 132; (r) the VHH domain comprises a CDRH1, a CDRH2, and a CDRH3 comprising the amino acid sequences set forth in SEQ ID NOs: 134, 135, and 136; (s) the VHH domain comprises a CDRH1, a CDRH2, and a CDRH3 comprising the amino acid sequences set forth in SEQ ID NOs: 138, 139, and 140; or (t) the VHH domain comprises a CDRH1, a CDRH2, and a CDRH3 comprising the amino acid sequences set forth in SEQ ID NOs: 142, 143, and 144. In a particular embodiment, the VH comprises a CDRH1, a CDRH2, and a CDRH3 comprising the amino acid sequences set forth in SEQ ID NOs: 62, 63, and 64 and the VL comprises a CDRL1, a CDRL2, and a CDRL3 comprising the amino acid sequences set forth in SEQ ID NOs: 66, 67, and 68.

In some embodiments: (a) the VH comprises the amino acid sequence set forth in SEQ ID NO: 11 and the VL comprises the amino acid sequence set forth in SEQ ID NO: 15; (b) the VH comprises the amino acid sequence set forth in SEQ ID NO: 21 and the VL comprises the amino acid sequence set forth in SEQ ID NO: 25; (c) the VH comprises the amino acid sequence set forth in SEQ ID NO: 31 and the VL comprises the amino acid sequence set forth in SEQ ID NO: 35; (d) the VH comprises the amino acid sequence set forth in SEQ ID NO: 41 and the VL comprises the amino acid sequence set forth in SEQ ID NO: 45; (e) the VH comprises the amino acid sequence set forth in SEQ ID NO: 51 and the VL comprises the amino acid sequence set forth in SEQ ID NO: 55; (f) the VH comprises the amino acid sequence set forth in SEQ ID NO: 61 and the VL comprises the amino acid sequence set forth in SEQ ID NO: 65; (g) the VH comprises the amino acid sequence set forth in SEQ ID NO: 71 and the VL comprises the amino acid sequence set forth in SEQ ID NO: 75; (h) the VH comprises the amino acid sequence set forth in SEQ ID NO: 81 and the VL comprises the amino acid sequence set forth in SEQ ID NO: 85; (i) the VH comprises the amino acid sequence set forth in SEQ ID NO: 91 and the VL comprises the amino acid sequence set forth in SEQ ID NO: 95; or (a) the VHH domain comprises the amino acid sequence set forth in any one of SEQ ID NOs: 101, 105, 109, 113, 117, 121, 125, 129, 133, 137, and 141. In particular embodiments, the VH comprises the amino acid sequence set forth in SEQ ID NO: 61 and the VL comprises the amino acid sequence set forth in SEQ ID NO: 65.

In certain embodiments, the polypeptide linker is selected from the group consisting of: TGEKP (SEQ ID NO: 2); $(GGGGS)_n$ wherein n=1, 2, 3, 4 or 5 (SEQ ID NOs: 3, and 976-979); EGKSSGSGSESKVD (SEQ ID NO: 4); KESGSVSSEQLAQFRSLD (SEQ ID NO: 5); LRQRDGERP (SEQ ID NO: 6); LRQKDGGGSERP (SEQ ID NO: 7); LRQKD (GGGS) 2ERP (SEQ ID NO: 8), GEGTSTGSGGSGGSGGAD (SEQ ID NO: 9), and GSTSGSGKPGSGEGSTKG (SEQ ID NO: 10).

In particular embodiments, the antibody or antigen binding fragment thereof comprises the amino acid sequence set forth in any one of SEQ ID NOs: 19, 20, 29, 30, 39, 40, 49, 50, 59, 60, 69, 70, 79, 80, 89, 90, 99, 100, 101, 105, 109, 113, 117, 121, 125, 129, 133, 137, and 141, preferably, SEQ ID NO: 69 or 70.

In various embodiments, the disclosure contemplates, in part, a bispecific antibody comprising the antibody or antigen binding fragment thereof contemplated herein.

In some embodiments, the bispecific antibody further comprises an anti-CD3 antibody that binds CD3δ, CD3ε, CD3γ, or CD3ζ.

In various embodiments, the disclosure contemplates, in part, an antibody conjugate comprising the antibody or antigen binding fragment thereof contemplated herein.

In certain embodiments, the antigen or antigen binding fragment thereof is conjugated to a cytotoxic agent.

In particular embodiments: (a) the cytotoxic agent is a toxin selected from the group consisting of: saporin, diphtheria toxin, *pseudomonas* exotoxin A, Ricin A chain derivatives, a small molecule toxin, and combinations thereof; (b) the cytotoxic agent is a radioisotope selected from the group consisting of: 131I, 90Y, 177Lu, 188Re, 67Cu, 213Bi, 211At, and 227Ac; (c) the cytotoxic agent is an RNA polymerase II inhibitor and/or RNA polymerase III inhibitor selected from the group consisting of: an amatoxin, α-amanitin, β-amanitin, γ-amanitin, ε-amanitin, amanin, amaninamide, amanullin, amanullinic acid and any functional fragments, derivatives or analogs thereof; or (d) the cytotoxic agent is a DNA-damaging agent selected from the group consisting of: an antitubulin agent, a DNA crosslinking agent, a DNA alkylating agent and a mitotic disrupting agent.

In various embodiments, the disclosure contemplates, in part, a chimeric antigen receptor (CAR) comprising the antibody or antigen binding fragment thereof contemplated herein; a spacer domain; a transmembrane domain, and one or more intracellular signaling domains.

In some embodiments, the spacer domain comprises a hinge domain or fragment thereof selected from the group consisting of: a CD4 hinge, a CD8β hinge, a CD8α hinge, a CD28 hinge, a CD134 hinge, a CD137 hinge, a CD152 hinge, a CD278 hinge, an IgG1 hinge, an IgG2 hinge, an IgG3 hinge, and an IgG4 hinge.

In particular embodiments, the spacer domain comprises an amino acid sequence set forth in any one of SEQ ID NOs: 145, 146, 147, 148, 149, and 150 or an amino acid sequence at least 95% identical thereto.

In some embodiments, the transmembrane domain is isolated or derived from a polypeptide selected from the group consisting of an alpha, beta, gamma, or delta chain of the T-cell receptor, CD3δ, CD3ε, CD3γ, CD3ζ, CD4, CD5, CD8a, CD9, CD16, CD22, CD27, CD28, CD33, CD37, CD45, CD64, CD80, CD86, CD134, CD137, CD152, CD154, CD278, amnionless (AMN), and programmed cell death 1 (PDCD1).

In particular embodiments, the transmembrane domain comprises an amino acid sequence set forth in any one of SEQ ID NOs: 151, 152, 153, 154, 155, 156, and 157 or an amino acid sequence at least 95% identical thereto.

In certain embodiments, the one or more intracellular signaling domains comprises a primary signaling domain isolated or derived from a polypeptide selected from the group consisting of FcRγ, FcRβ, CD3γ, CD3δ, CD3ε, CD3ζ, CD22, CD79a, CD79b, and CD66d.

In some embodiments, the one or more intracellular signaling domains comprises a primary signaling domain isolated from CD3ζ.

In certain embodiments, the primary signaling domain comprises an amino acid sequence set forth in SEQ ID NO: 158 or an amino acid sequence at least 95% identical thereto.

In particular embodiments, the one or more intracellular signaling domains comprises a costimulatory signaling domain isolated or derived from a polypeptide selected from the group consisting of TLR1, TLR2, TLR3, TLR4, TLR5, TLR6, TLR7, TLR8, TLR9, TLR10, CARD11, CD2, CD7, CD27, CD28, CD30, CD40, ICAM, CD83, CD94, CD134 (OX40), CD137 (4-1BB), CD278 (ICOS), DAP10, LAT, SLP76, TRAT1, TNFR2, TNFRS14, TNFRS18, TNFRS25, and ZAP70.

In some embodiments, the one or more intracellular signaling domains comprises a costimulatory signaling domain comprising an amino acid sequence set forth in any one of SEQ ID NOs: 159, 160, 161, 162, 163, and 164 or an amino acid sequence at least 95% identical thereto.

In various embodiments, the disclosure contemplates, in part, a CAR comprising an antibody or antigen binding fragment thereof comprises the amino acid sequence set forth in any one of SEQ ID NOs: 39, 59, 70, 90, 101, or 117; a spacer domain comprising the amino acid sequence set forth in any one of SEQ ID NOs: 145, 146, and 148 or an amino acid sequence at least 95% identical thereto; a transmembrane domain comprising the amino acid sequence set forth in SEQ ID NOs: 151 or 153; one or more intracellular signaling domains comprising a costimulatory signaling domain comprising an amino acid sequence set forth in any one of SEQ ID NOs: 159, 160, and 162 or an amino acid sequence at least 95% identical thereto and further comprising a primary signaling domain comprising an amino acid sequence set forth in SEQ ID NO: 158 or an amino acid sequence at least 95% identical thereto.

In various embodiments, the disclosure contemplates, in part, a CAR comprising the amino acid sequence set forth in any one of SEQ ID NOs: 165-860.

In various embodiments, the disclosure contemplates, in part, a CAR comprising the amino acid sequence set forth in any one of SEQ ID NOs: 261, 262, 263, 264, 265, 266, 267, 268, 269, 270, 271, 272, 273, 274, 275, 276, 277, 278, 279, 280, 281, 282, and 283.

In various embodiments, the disclosure contemplates, in part, a CAR comprising the amino acid sequence set forth in any one of SEQ ID NOs: 357, 358, 359, 360, 361, 362,363, 364, 365, 366, 367, 368, 369, 370 371, 372, 373, 374, 375, 376, 377, 378, 379, and 380.

In various embodiments, the disclosure contemplates, in part, a CAR comprising the amino acid sequence set forth in any one of SEQ ID NOs: 429, 430, 431, 432, 433, 434, 435, 436, 437, 438, 439, 440, 441, 442, 443, 444, 445, 446, 447, 448, 449, 450, 451, and 452. In particular embodiments, a CAR comprising the amino acid sequence set forth in SEQ ID NO: 429 or an amino acid sequence 95% identical thereto.

In various embodiments, the disclosure contemplates, in part, a CAR comprising the amino acid sequence set forth in any one of SEQ ID NOs: 525, 526, 527, 528, 529, 530, 531, 532, 533, 534, 535, 536, 537, 538, 539, 540, 541, 542, 543, 544, 545, 546, 547, and 548.

In various embodiments, the disclosure contemplates, in part, a CAR comprising the amino acid sequence set forth in any one of SEQ ID NOs: 597, 598, 599, 600, 601, 602, 603, 604, 605, 606, 607, 608, 609, 610, 611, 612, 613, 614, 615, 616, 617, 618, 619, and 620.

In various embodiments, the disclosure contemplates, in part, a CAR comprising the amino acid sequence set forth in any one of SEQ ID NOs: 693, 694, 695, 696, 697, 698, 699, 700, 701, 702, 703, 704, 705, 706, 707, 708, 709, 710, 711, 712, 713, 714, 715, and 716.

In some embodiments, the CAR further comprises a signal peptide.

In particular embodiments, the signal peptide comprises an amino acid sequence set forth in any one of SEQ ID NOs: 861, 862, 863, 864, 865, 866, 867, 868, 869, 870, 871, 872, and 873.

In particular embodiments, a polynucleotide encoding a CAR, comprises a polynucleotide sequence set forth in any one of SEQ ID NOs: 905-924.

In particular embodiments, a polynucleotide encoding a signal peptide and a CAR comprises a polynucleotide sequence set forth in any one of SEQ ID NOs: 925-944.

In various embodiments, the disclosure contemplates, in part, a polynucleotide encoding an antibody or antigen binding fragment thereof, a bispecific antibody, an antibody conjugate, or a CAR contemplated herein.

In various embodiments, the disclosure contemplates, in part, a polynucleotide encoding or comprising a promoter operably linked to a polynucleotide set forth in any one of SEQ ID NOS: 905-944.

In certain embodiments, the promoter comprises the polynucleotide sequence set forth in any one of SEQ ID NOs: 948, 949, 950, 951, 952, and 953, preferably SEQ ID NO: 949.

In particular embodiments, the polynucleotide further comprises a post-transcriptional response element.

In some embodiments, the post-transcriptional response element comprises the polynucleotide sequence set forth in any one of SEQ ID NOs: 945, 946, and 947.

In various embodiments, the disclosure contemplates, in part, a DNA comprising the polynucleotide sequence set forth in any one of SEQ ID NOs: 945, 946, and 947.

In various embodiments, the disclosure contemplates, in part, an RNA encoded by the polynucleotide sequence set forth in any one of SEQ ID NOs: 945, 946, and 947.

In various embodiments, the disclosure contemplates, in part, a vector comprising the polynucleotide sequence set forth in any one of SEQ ID NOs: 945, 946, and 947.

In various embodiments, the disclosure contemplates, in part, a vector encoding or comprising a promoter comprising a sequence set forth in SEQ ID NO: 950 operably linked to a polynucleotide encoding a signal peptide and a chimeric antigen receptor comprising an anti-BCMA antibody or antigen binding fragment thereof comprising an amino acid set forth in any one of SEQ ID NOs: 11-144, and optionally comprising a polynucleotide comprising a posttranscriptional regulatory element set forth in any one of SEQ ID NOs: 945-947.

In various embodiments, the disclosure contemplates, in part, a vector encoding or comprising a promoter comprising a sequence set forth in SEQ ID NO: 950 operably linked to a polynucleotide encoding a signal peptide and a chimeric antigen receptor comprising an anti-BCMA antibody or antigen binding fragment thereof comprising an amino acid set forth in any one of SEQ ID NOs: 20, 30, 39, 50, 59, 70, 80, 90, 100, 101, 105, 109, 113, 117, 121, 125, 129, 133, 137, and 141, and optionally comprising a polynucleotide comprising a posttranscriptional regulatory element set forth in any one of SEQ ID NOs: 945-947.

In various embodiments, the disclosure contemplates, in part, a vector encoding or comprising a promoter comprising a sequence set forth in SEQ ID NO: 950 operably linked to a polynucleotide encoding a signal peptide and a chimeric antigen receptor comprising an amino acid set forth in any one of SEQ ID NOs: 165-860, and optionally comprising a polynucleotide comprising a posttranscriptional regulatory element set forth in any one of SEQ ID NOs: 945-947.

In various embodiments, the disclosure contemplates, in part, a vector encoding or comprising a promoter comprising a sequence set forth in SEQ ID NO: 950 operably linked to a polynucleotide encoding a signal peptide and a chimeric antigen receptor comprising an amino acid set forth in any one of SEQ ID NOs: 189, 237, 261, 333, 357, 429, 477, 525, 573, 597, 621, 645, 669, 693, 717, 741, 765, 789, 813, and 837, and optionally comprising a polynucleotide comprising a posttranscriptional regulatory element set forth in any one of SEQ ID NOs: 945-947.

In various embodiments, the disclosure contemplates, in part, a vector encoding or comprising a promoter comprising a sequence set forth in SEQ ID NO: 950 operably linked to a polynucleotide comprising a polynucleotide sequence set forth in SEQ ID NO: 904 and a polynucleotide sequence set forth in any one of SEQ ID NOs: 905-924, and optionally comprising a polynucleotide comprising a posttranscriptional regulatory element set forth in any one of SEQ ID NOs: 945-947.

In particular embodiments, a vector encoding or comprising a promoter comprises a sequence set forth in SEQ ID NO: 950 operably linked to a polynucleotide comprising a polynucleotide sequence set forth in any one of SEQ ID NOs: 925-944, and optionally comprises a polynucleotide comprising a posttranscriptional regulatory element set forth in any one of SEQ ID NOs: 945-947.

In various embodiments, the disclosure contemplates, in part, a vector encoding or comprising a promoter comprising a sequence set forth in SEQ ID NO: 949 operably linked to a polynucleotide encoding a signal peptide and a chimeric antigen receptor comprising an anti-BCMA antibody or antigen binding fragment thereof comprising an amino acid set forth in any one of SEQ ID NOs: 11-144, and optionally comprising a polynucleotide comprising a posttranscriptional regulatory element set forth in any one of SEQ ID NOs: 945-947.

In various embodiments, the disclosure contemplates, in part, a vector encoding or comprising a promoter comprising a sequence set forth in SEQ ID NO: 949 operably linked to a polynucleotide encoding a signal peptide and a chimeric antigen receptor comprising an anti-BCMA antibody or antigen binding fragment thereof comprising an amino acid set forth in any one of SEQ ID NOs: 20, 30, 39, 50, 59, 70, 80, 90, 100, 101, 105, 109, 113, 117, 121, 125, 129, 133, 137, and 141, and optionally comprising a polynucleotide comprising a posttranscriptional regulatory element set forth in any one of SEQ ID NOs: 945-947.

In various embodiments, the disclosure contemplates, in part, a vector encoding or comprising a promoter comprising a sequence set forth in SEQ ID NO: 949 operably linked to a polynucleotide encoding a signal peptide and a chimeric antigen receptor comprising an amino acid set forth in any one of SEQ ID NOs: 165-860, and optionally comprising a polynucleotide comprising a posttranscriptional regulatory element set forth in any one of SEQ ID NOs: 945-947.

In various embodiments, the disclosure contemplates, in part, a vector encoding or comprising a promoter comprising a sequence set forth in SEQ ID NO: 949 operably linked to a polynucleotide encoding a signal peptide and a chimeric antigen receptor comprising an amino acid set forth in any one of SEQ ID NOs: 189, 237, 261, 333, 357, 429, 477, 525, 573, 597, 621, 645, 669, 693, 717, 741, 765, 789, 813, and 837, preferably SEQ ID NO: 429 and optionally comprising a polynucleotide comprising a posttranscriptional regulatory element set forth in any one of SEQ ID NOs: 945-947.

In various embodiments, the disclosure contemplates, in part, a vector encoding or comprising a promoter comprising a sequence set forth in SEQ ID NO: 949 operably linked to a polynucleotide comprising a polynucleotide sequence set forth in SEQ ID NO: 904 and a polynucleotide sequence set forth in any one of SEQ ID NOs: 905-924, preferably SEQ ID NO: 910 and optionally comprising a polynucleotide comprising a posttranscriptional regulatory element set forth in any one of SEQ ID NOs: 945-947.

In certain embodiments, a vector encoding or comprising a promoter comprises a sequence set forth in SEQ ID NO: 949 operably linked to a polynucleotide comprising a polynucleotide sequence set forth in any one of SEQ ID NOs: 925-944, preferably SEQ ID NO: 930 and optionally comprises a polynucleotide comprising a posttranscriptional regulatory element set forth in any one of SEQ ID NOs: 945-947.

In certain embodiments, the vector is an expression vector.

In particular embodiments, the vector is a transfer plasmid or viral vector.

In some embodiments, the vector is a plasmid.

In particular embodiments, the vector is a viral vector selected from the group consisting of an adenoviral (Ad) vector, an adeno-associated virus (AAV) vector, a herpes simplex virus (HSV) vector, a parvovirus vector, a rhabdovirus vector, a vesiculovirus vector, a paramyxovirus vector, a morbillovirus vector, a henipavirus vector, an alphavirus vector, a flavivirus vector, a retroviral vector, and a lentiviral vector (LVV).

In certain embodiments, the lentiviral vector is engineered or derived from the genome of a lentivirus selected from the group consisting of: HIV (HIV type 1 or HIV type 2); visna-maedi virus (VMV); caprine arthritis-encephalitis virus (CAEV); equine infectious anemia virus (EIAV); feline immunodeficiency virus (FIV); bovine immune deficiency virus (BIV); and simian immunodeficiency virus (SIV).

In various embodiments, the disclosure contemplates, in part, a lentiviral vector comprising: a 5' long terminal repeat (LTR) comprising R and U5 regions; a Psi (Ψ) packaging signal; a cPPT/FLAP; an export element; a polynucleotide encoding or comprising a promoter operably linked to a polynucleotide sequence set forth in SEQ ID NO: 904 and a polynucleotide sequence set forth in any one of SEQ ID NOs: 905-924 preferably SEQ ID NO: 910; optionally a WPRE; a 3' LTR comprising U3 and R regions; a polyadenylation signal and a poly(A) tail.

In various embodiments, the disclosure contemplates, in part, a lentiviral vector comprising: a 5' long terminal repeat (LTR) comprising R and U5 regions; a Psi (Ψ) packaging signal; a cPPT/FLAP; an export element; a polynucleotide encoding or comprising a promoter operably linked to a polynucleotide sequence set forth in any one of SEQ ID NOs: 925-944 preferably SEQ ID NO: 930; optionally a WPRE; a 3' LTR comprising U3 and R regions; a polyadenylation signal and a poly(A) tail.

In various embodiments, the disclosure contemplates, in part, an RNA comprising: a 5' long terminal repeat (LTR) comprising R and U5 regions; a Psi (Ψ) packaging signal; a cPPT/FLAP; an export element; a polynucleotide encoding a promoter operably linked to a polynucleotide sequence set forth in SEQ ID NO: 904 and a polynucleotide sequence set forth in any one of SEQ ID NOs: 905-924 preferably SEQ ID NO: 910; optionally a WPRE; a 3' LTR comprising U3 and R regions; a polyadenylation signal and optionally a poly(A) tail.

In various embodiments, the disclosure contemplates, in part, an RNA comprising: a 5' long terminal repeat (LTR) comprising R and U5 regions; a Psi (Ψ) packaging signal; a cPPT/FLAP; an export element; a polynucleotide encoding a promoter operably linked to a polynucleotide sequence set forth in any one of SEQ ID NOs: 925-944 preferably SEQ ID NO: 930; optionally a WPRE; a 3' LTR comprising U3 and R regions; a polyadenylation signal and optionally a poly(A) tail.

In various embodiments, the disclosure contemplates, in part, a recombinant lentivirus comprising one or more copies of a lentiviral vector or an RNA contemplated herein.

In various embodiments, the disclosure contemplates, in part, a composition comprising an antibody or antigen binding fragment thereof, a bispecific antibody, an antibody conjugate, a CAR, a polynucleotide, a vector, an RNA, or a recombinant lentivirus contemplated herein.

BRIEF DESCRIPTION OF SEVERAL VIEWS OF THE DRAWINGS

The patent or application file contains at least one drawing executed in color. Copies of this patent or patent application publication with color drawings will be provided by the Office upon request and payment of the necessary fee.

BRIEF DESCRIPTION OF THE SEQUENCE IDENTIFIERS

Figure 1:
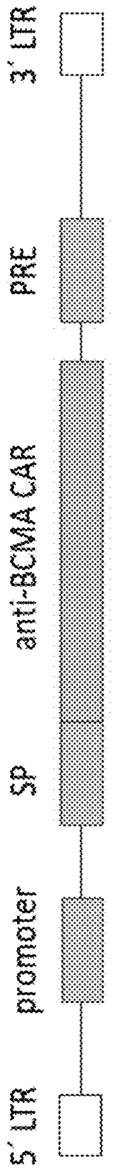
FIG. 1 is a cartoon of a vector encoding a promoter operably linked to a polynucleotide encoding an anti-BCMA CAR and an optional post-transcriptional response element (PRE) operably linked to the 3' prime end of the polynucleotide encoding the anti-BCMA CAR.

SEQ ID NO: 1 sets forth an amino acid sequence of a B cell maturation antigen (BCMA) polypeptide.

SEQ ID NOs: 2-10 and 976-979 set forth amino acid sequences of polypeptide linkers.

SEQ ID NOs: 11-144 set forth amino acid sequences of antibodies.

SEQ ID NOs: 145-150 set forth amino acid sequences of spacer domains.

SEQ ID NOs: 151-157 set forth amino acid sequences of transmembrane domains.

SEQ ID NOs: 158-164 set forth amino acid sequences of intracellular signaling domains.

SEQ ID NOs: 165-860 set forth amino acid sequences of chimeric antigen receptors (CARs).

SEQ ID NOs: 861-873 set forth amino acid sequences of signal peptides.

SEQ ID NOs: 874-893 set forth nucleic acid sequences encoding antibodies.

SEQ ID NOs: 894-897 set forth nucleic acid sequences encoding spacer domains.

SEQ ID NOs: 898-899 set forth nucleic acid sequences encoding transmembrane domains.

SEQ ID NOs: 900-903 set forth nucleic acid sequences encoding intracellular signaling domains.

SEQ ID NO: 904 sets forth a nucleic acid sequence encoding a signal peptide.

SEQ ID NOs: 905-924 set forth nucleic acid sequences encoding chimeric antigen receptors (CARs) without a signal peptide.

SEQ ID NOs: 925-944 set forth nucleic acid sequences encoding CARs comprising a signal peptide.

SEQ ID NOs: 945-947 set forth nucleic acid sequences of post-transcriptional response elements.

SEQ ID NOs: 948-953 set forth nucleic acid sequences of promoters.

SEQ ID NOs: 954-955 set forth amino acid sequences of anti-BCMA CARs.

SEQ ID NOs: 956-975 set forth amino acid sequences of viral self-cleaving peptides.

SEQ ID NOs: 976-979 set forth amino acid sequences of polypeptide linkers.

SEQ ID NO: 980 sets forth the nucleic acid sequence of a Kozak sequence.

In the foregoing sequences, X, if present, refers to any amino acid, a specified group of amino acids or the absence of an amino acid.

DETAILED DESCRIPTION

A. Overview

Chimeric antigen receptors (CARs) are used to redirect immune effector cells to target cells. Typically, immune effector cells are harvested from a patient, modified ex vivo with a vector to express a CAR, and then infused back into the patient where the CAR expressing immune effector cells seek out and destroy target cells, e.g., cancer cells.

Thoughtful vector design and consideration of CAR architecture both contribute to an effective CAR-based therapy. Vector design considerations include but are not limited to selection of the type of vector, e.g., viral or non-viral; promoter selection; selection of post-transcriptional regulatory elements; and the like. CARs comprise several components including but not limited to a target antigen binding moiety, e.g., a ligand, antibody or antigen binding fragment thereof; a spacer domain that positions the target binding domain the appropriate distance from the immune effector cell surface; a transmembrane domain that anchors the CAR to the immune effector cell; and one or more intracellular signaling domains that transduce extracellular signals to intracellular cell signaling cascades that provide for durable and effective immune responses. Too much CAR expression or activity could result in tonic signaling (activation of immune effector cells in the absence of target cells) and too little CAR expression or activity may result in ineffective recognition and destruction of target cells.

Recently, ex vivo CAR T cell therapies that target B cell maturation antigen (BCMA) have been used to treat relapsed and refractory multiple myeloma. Although many multiple myeloma patients that have been treated with ex vivo anti-BCMA CAR T cell therapies experience partial or complete remissions, most relapse and succumb to the disease. There is a significant unmet need for a durable, one-time, and potentially curative treatment for multiple myeloma.

The present disclosure offers solutions to foregoing challenges and others that exist in the field of treating multiple myeloma using anti-BCMA binding proteins.

The present disclosure generally relates to, in part, anti-BCMA binding proteins comprising an antibody or antigen binding fragment thereof directed against BCMA. In particular embodiments, an anti-BCMA binding protein is an anti-BCMA antibody or antigen binding fragment thereof; a polypeptide comprising an anti-BCMA antibody or antigen binding fragment thereof; a bispecific antibody comprising an anti-BCMA antibody or antigen binding fragment thereof and an anti-CD3 antibody; an immunoconjugate comprising an anti-BCMA antibody drug linked to a cytotoxic agent; or an anti-BCMA chimeric antigen receptor.

The present disclosure also relates, in part, polynucleotides encoding the polypeptides, vectors for expressing the polynucleotides, and compositions comprising the foregoing.

In particular embodiments, a chimeric antigen receptor comprises one or more anti-BCMA antibodies or antigen binding fragments thereof. The anti-BCMA CARs provide several advantages compared to existing anti-BCMA CARs including but not limited to decreased immunogenicity because the CAR components are derived from human proteins; improved cytokine profile including increased expression of interferon gamma (IFNγ) and interleukin 2 (IL-2) in the presence of BCMA expressing target cells; low or absent tonic signaling (antigen independent signaling), and increased efficacy in mouse models when compared to existing CARs.

Techniques for recombinant (i.e., engineered) DNA, peptide and oligonucleotide synthesis, immunoassays, tissue culture, transformation (e.g., electroporation, lipofection), enzymatic reactions, purification and related techniques and procedures may be generally performed as described in various general and more specific references in microbiology, molecular biology, biochemistry, molecular genetics, cell biology, virology and immunology as cited and discussed throughout the present specification. See, e.g., Sambrook et al., *Molecular Cloning: A Laboratory Manual,* 4th ed., Cold Spring Harbor Laboratory Press, Cold Spring Harbor, N.Y.; *Current Protocols in Molecular Biology* (John Wiley and Sons, updated July 2008); *Short Protocols in Molecular Biology: A Compendium of Methods from Current Protocols in Molecular Biology*, Greene Pub. Associates and Wiley-Interscience (2002); Glover, *DNA Cloning: A Practical Approach*, vol. I & II (IRL Press, Oxford Univ. Press USA, 1985); *Current Protocols in Immunology* (Edited by: John E. Coligan, Ada M. Kruisbeek, David H. Margulies, Ethan M. Shevach, Warren Strober 2001 John Wiley & Sons, NY, NY); *Real-Time PCR: Current Technology and Applications*, Edited by Julie Logan, Kirstin *Edwards and Nick Saunders,* 2009, *Caister* Academic Press, Norfolk, UK; Anand, Techniques for the Analysis of Complex Genomes, (Academic Press, New York, 1992); Guthrie and Fink, *Guide to Yeast Genetics and Molecular Biology* (Academic Press, New York, 1991); Oligonucleotide Synthesis (N. Gait, Ed., 1984); Nucleic Acid the Hybridization (B. Hames & S. Higgins, Eds., 1985); Transcription and Translation (B. Hames & S. Higgins, Eds., 1984); Animal Cell Culture (R. Freshney, Ed., 1986); Perbal, *A Practical Guide to Molecular Cloning* (1984); Next-Generation Genome Sequencing (Janitz, 2008 Wiley-VCH); PCR Protocols (Methods in Molecular Biology) (Park, Ed., 3rd Edition, 2010 Humana Press); Immobilized Cells and Enzymes (IRL Press, 1986); the treatise, Methods in Enzymology (Academic Press, Inc., N.Y.); Gene Transfer Vectors for Mammalian Cells (J. H. Miller and M. P. Calos eds., 1987, Cold Spring Harbor Laboratory); Harlow and Lane, Antibodies, (Cold Spring Harbor Laboratory Press, Cold Spring Harbor, N.Y., 1998); Immunochemical Methods in Cell and Molecular Biology (Mayer and Walker, eds., Academic Press, London, 1987); *Handbook of Experimental Immunology*, Volumes I-IV (D. M. Weir and CC Blackwell, eds., 1986); Roitt, Essential Immunology, 6th Edition, (Blackwell Scientific Publications, Oxford, 1988); *Current Protocols in Immunology* (Q. E. Coligan, A. M. Kruisbeek, D. H. Margulies, E. M. Shevach and W. Strober, eds., 1991); *Annual Review of Immunology*; as well as monographs in journals such as Advances in Immunology.

B. Definitions

Prior to setting forth this disclosure in more detail, it may be helpful to an understanding thereof to provide definitions of certain terms to be used herein.

Unless defined otherwise, all technical and scientific terms used herein have the same meaning as commonly understood by those of ordinary skill in the art to which the invention belongs. Although any methods and materials similar or equivalent to those described herein can be used in the practice or testing of particular embodiments, preferred embodiments of compositions, methods and materials are described herein. For the purposes of the present disclosure, the following terms are defined below.

The articles "a," "an," and "the" are used herein to refer to one or to more than one (i.e., to at least one, or to one or more) of the grammatical object of the article. By way of example, "an element" means one element or one or more elements.

The use of the alternative (e.g., "or") should be understood to mean either one, both, or any combination of the recited alternatives.

The term "and/or" should be understood to mean either one of, or both of, the alternatives.

As used herein, the term "about" or "approximately" refers to a quantity, level, value, number, frequency, percentage, dimension, size, amount, weight or length that varies by as much as 15%, 10%, 9%, 8%, 7%, 6%, 5%, 4%, 3%, 2% or 1% to a reference quantity, level, value, number, frequency, percentage, dimension, size, amount, weight or length. In one embodiment, the term "about" or "approximately" refers a range of quantity, level, value, number, frequency, percentage, dimension, size, amount, weight or length ±15%, ±10%, ±9%, ±8%, ±7%, ±6%, ±5%, ±4%, ±3%, ±2%, or ±1% of a reference quantity, level, value, number, frequency, percentage, dimension, size, amount, weight or length.

In one embodiment, a range, e.g., 1 to 5, about 1 to 5, or about 1 to about 5, refers to each numerical value encompassed by the range. For example, in one non-limiting and merely illustrative embodiment, the range "1 to 5" is equivalent to the expression 1, 2, 3, 4, 5; or 1.0, 1.5, 2.0, 2.5, 3.0, 3.5, 4.0, 4.5, or 5.0; or 1.0, 1.1, 1.2, 1.3, 1.4, 1.5, 1.6, 1.7, 1.8, 1.9, 2.0, 2.1, 2.2, 2.3, 2.4, 2.5, 2.6, 2.7, 2.8, 2.9, 3.0, 3.1, 3.2, 3.3, 3.4, 3.5, 3.6, 3.7, 3.8, 3.9, 4.0, 4.1, 4.2, 4.3, 4.4, 4.5, 4.6, 4.7, 4.8, 4.9, or 5.0.

As used herein, the term "substantially" refers to a quantity, level, value, number, frequency, percentage, dimension, size, amount, weight or length that is 80%, 85%, 90%, 91%, 92%, 93%, 94%, 95%, 96%, 97%, 98%, 99% or higher compared to a reference quantity, level, value, number, frequency, percentage, dimension, size, amount, weight or length. In one embodiment, "substantially the same" refers to a quantity, level, value, number, frequency, percentage, dimension, size, amount, weight or length that produces an effect, e.g., a physiological effect, that is approximately the same as a reference quantity, level, value, number, frequency, percentage, dimension, size, amount, weight or length.

Throughout this specification, unless the context requires otherwise, the words "comprise", "comprises" and "comprising" will be understood to imply the inclusion of a stated step or element or group of steps or elements but not the exclusion of any other step or element or group of steps or elements. By "consisting of" is meant including, and limited to, whatever follows the phrase "consisting of." Thus, the phrase "consisting of" indicates that the listed elements are required or mandatory and that no other elements may be present. The phrase "consisting essentially of" means including any elements listed after the phrase and other elements that do not interfere with or contribute to the activity or action specified in the disclosure for the listed elements. Thus, the phrase "consisting essentially of" indicates that the listed elements are required or mandatory but that no other elements are present that materially affect the activity or action of the listed elements.

Reference throughout this specification to "one embodiment," "an embodiment," "a particular embodiment," "a related embodiment," "a certain embodiment," "an additional embodiment," or "a further embodiment" or combinations thereof means that a particular feature, structure or characteristic described in connection with the embodiment is included in at least one embodiment. Thus, the appearances of the foregoing phrases in various places throughout this specification are not necessarily all referring to the same embodiment. Furthermore, the particular features, structures, or characteristics may be combined in any suitable manner in one or more embodiments. It is also understood that the positive recitation of a feature in one embodiment, serves as a basis for excluding the feature in a particular embodiment.

The terms, "binding domain," "extracellular binding domain," and "extracellular antigen binding domain" are used interchangeably and refers to a domain that enables a chimeric antigen receptor (CAR) to specifically bind to a target antigen. The binding domain may be derived either from a natural, synthetic, semi-synthetic, or recombinant source.

A "spacer domain" refers to a polypeptide domain or sequence of amino acids in a chimeric antigen receptor that plays a role in positioning the antigen binding domain away from the immune effector cell surface to enable proper cell/cell contact, antigen binding and activation. In particular embodiments, a spacer domain may also be referred to, and is synonymous with, a hinge domain. A spacer domain is placed between a binding domain and a transmembrane domain (TM). A spacer domain may be derived either from a natural, synthetic, semi-synthetic, or recombinant source. A spacer domain may be altered by substituting one or more cysteine and/or proline residues in a naturally occurring immunoglobulin hinge domain with one or more other amino acid residues (e.g., one or more serine residues).

A "transmembrane domain" or "TM domain" refers to a hydrophobic portion of a chimeric antigen receptor polypeptide that anchors the polypeptide to the plasma membrane of the cell. The TM domain may be derived either from a natural, synthetic, semi-synthetic, or recombinant source.

An "intracellular signaling domain" refers to a polypeptide domain that participates in transducing the message of effective binding of a target antigen by a chimeric antigen receptor expressed on an immune effector cell to the immune effector cell's interior to elicit one or more effector functions (an "effector function" refers to a specialized function of an immune effector cell), e.g., activation, cytokine production, proliferation and cytotoxic activity, including the release of cytotoxic factors, or other cellular responses elicited with antigen binding to the receptor expressed on the immune effector cell. "Intracellular signaling domains" include a polypeptide domain or functional fragment thereof, which transduces an effector function signal and that directs a cell to perform a specialized function. The term intracellular signaling domain is meant to include any truncated portion of an intracellular signaling domain sufficient to transduce effector function signal.

T cell activation can be said to be mediated by two distinct classes of intracellular signaling domains: primary signaling domains that initiate antigen-dependent primary activation through the TCR (e.g., a TCR/CD3 complex) and costimulatory signaling domains that act in an antigen-independent manner to provide a secondary or costimulatory signal.

A "primary signaling domain" refers to a signaling domain that regulates the primary activation of a TCR complex either in a stimulatory way, or in an inhibitory way. Primary signaling domains that act in a stimulatory manner may contain one or more signaling motifs which are known as immunoreceptor tyrosine-based activation motifs or ITAMs.

A "costimulatory signaling domain" or "costimulatory signaling domain" refers to an intracellular signaling domain of a costimulatory molecule. Costimulatory molecules are cell surface molecules other than antigen receptors or Fc receptors that provide a second signal required for efficient activation and function of T lymphocytes upon binding to antigen.

"Linker," "peptide linker," and "polypeptide linker" are used interchangeably and refer to a plurality of amino acid residues between various polypeptide domains added for appropriate spacing, conformation, and function. A polypeptide linker sequence may be employed to separate any two or more polypeptide components by a distance sufficient to ensure that each polypeptide folds into its appropriate secondary and tertiary structures so as to allow the polypeptide domains to exert their desired functions. Linkers include a "variable domain linking sequence," an amino acid sequence that connects two or more domains of an antibody or antigen binding fragments thereof and provides a spacer function compatible with interaction of the two sub-binding domains so that the resulting polypeptide retains a specific binding affinity to the same target molecule as an antibody that comprises the same light and/or heavy chain variable domains. A linker may be 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 or more amino acids long. Illustrative examples of linkers include, but are not limited to the following amino acid sequences: TGEKP (SEQ ID NO: 2); $(GGGGS)_n$ wherein n=1, 2, 3, 4 or 5 (SEQ ID NOs: 3, and 976-979); EGKSSGSGSESKVD (SEQ ID NO: 4); KESGSVSSEQLAQFRSLD (SEQ ID NO: 5); LRQRDGERP (SEQ ID NO: 6); LRQKDGGGSERP (SEQ ID NO: 7); $LRQKD(GGGS)_2ERP$ (SEQ ID NO: 8), GEGTSTGSGGSGGSGGAD (SEQ ID NO: 9), and GSTSGSGKPGSGEGSTKG (SEQ ID NO: 10).

Additional definitions are set forth throughout this disclosure.

C. Antibodies

B cell maturation antigen (BCMA) is a member of the tumor necrosis factor receptor superfamily 17 (TNFRSF17) and is highly expressed on the plasma cells of multiple myeloma (MM) patients. The restricted expression of BCMA makes it a suitable therapeutic target for treating multiple myeloma. The present disclosure contemplates antibodies and antigen binding fragments thereof that bind BCMA. An "antibody" refers to a polypeptide or antigen binding fragment thereof that comprises at least a light chain immunoglobulin variable region and/or a heavy chain immunoglobulin variable region, which specifically recognizes and binds one or more epitopes of a BCMA polypeptide, e.g., SEQ ID NO: 1 (MLQMAGQCSQNEYFDSLLHACIPCQLRCSSNTPPLTCQRYCNASVTNSVKGTNAILWTCLGLSLIISLAVFVLMFLLRKINSEPLKDEFKNTGSGLLGMANIDLEKSRTGDEIILPRGLEYTVEECTCEDCIKSKPKVDSDHCFPLPAMEEGATILVTTKTNDYCKSLPAALSATEIEK SISAR).

An antibody or antigen binding fragment thereof "specifically binds" a BCMA polypeptide if it binds with an affinity or $K_a \geq 10^5\ M^{-1}$, while not significantly binding other components present in a test sample. An antibody or antigen binding fragment thereof may be classified as "high affinity" or "low affinity." "High affinity" antibodies or antigen binding fragments thereof refer to antibodies that bind BCMA with a $K_a$ of at least $10^7\ M^{-1}$, at least $10^8\ M^{-1}$, at least $10^9\ M^{-1}$, at least $10^{10}\ M^{-1}$, at least $10^{11}\ M^{-1}$, at least $10^{12}\ M^{-1}$, or at least $10^{13}\ M^{-1}$. "Low affinity" antibodies or antigen binding fragments thereof refer to antibodies that bind BCMA with a $K_a$ of up to $10^7\ M^{-1}$, up to $10^6\ M^{-1}$, up to $10^5\ M^{-1}$. Alternatively, affinity may be defined as an equilibrium dissociation constant ($K_d$) of a particular binding interaction with units of M (e.g., $10^{-5}$ M to $10^{-13}$ M).

Antibodies include polyclonal and monoclonal antibodies and antigen binding fragments thereof; camelid antibodies, and human antibodies, and antigen binding fragments thereof; and chimeric antibodies, an antibody that comprises variable regions from a non-human species and human constant regions, heteroconjugate antibodies, and humanized antibodies, an antibody that comprises complementarity determining regions (CDRs) from a non-human species and human framework and constant regions, and antigen binding fragments thereof.

Chimeric, humanized, and human antibodies comprise two heavy chains and two light chains. Each heavy chain consists of a variable region (VH) and three constant regions (CH1, CH2, CH3), while each light chain consists of a variable region (VL) and a constant region (CL). Mammalian immunoglobulin heavy chains are classified as immunoglobulin (Ig)A, IgD, IgE, IgG, and IgM. Mammalian immunoglobulin light chains are classified as λ or κ.

Light and heavy chain variable regions contain a "framework" region interrupted by three hypervariable regions, also called "complementarity-determining regions" or "CDRs."

The sequences of the framework regions of different light or heavy chains are relatively conserved within a species, such as humans. The framework regions serve to position and align the CDRs in three-dimensional space to bind to an epitope. The CDRs of each chain are numbered sequentially starting from the N-terminus and are also typically identified by the chain in which the particular CDR is located. Heavy chain CDRs are referred to as CDRH1, CDRH2, and CDRH3, and light chain CDRs are referred to as CDRL1, CDRL2, and CDRL3. Although CDRs vary from antibody to antibody, the limited number of amino acid positions within the CDRs directly involved in antigen binding are called specificity determining residues (SDRs).

CDRs can be defined or identified by conventional methods, such as by sequence according to Wu and Kabat, J Exp Med. 132 (2):211-50 (1970) and Kabat and Wu, Ann New York Acad Sci. 190:382-93 (1971), or by structure according to Chothia and Lesk, J Mol. Biol. 196 (4): 901-917 (1987) and Chothia et al., Nature. 342:877-83 (1989). Other boundaries defining CDRs overlapping with the Kabat CDRs have been described by Padlan et al., FASEB J. 9:133-9 (1995) and MacCallum et al., J Mol Biol. 262:732-745 (1996).

Additional methods of determining CDRs include the Gelfand numbering system described in Gelfand and Kister, PNAS USA. 92:10884-8 (1995), Gelfand et al., Protein Eng. 11:1015-25 (1998), and Gelfand et al., PNAS USA. 93:3675-8 (1996); the Honneger number system described in Honegger and Plückthun, J Mol Biol. 309:657-70 (2001); the AbM numbering system described by Abhinandan and Martin, Mol Immunol. 45:3832-9 (2008); and the IMGT numbering system described in Giudicelli et al., Nucleic Acids Res. 25:206-11 (1997), Lefranc, Immunol Today 18:509 (1997), and Lefranc et al., Dev Comp Immunol. 27:55-77 (2003). Proprietary and publicly programs that identify CDRs are available, e.g., abYsis (abysis.org/abysis/) and IMGT/V-QUEST (imgt.org/IMGT_vquest).

"VL" or "$V_L$" refers to the variable region of an immunoglobulin light chain or antigen binding fragment thereof. "VH" or "$V_H$" refer to the variable region of an immunoglobulin heavy chain or antigen binding fragment thereof.

An "antigen binding fragment" or "antigen binding portion" refers to one or more fragments of an antibody that retain the ability to specifically bind to an antigen. An "isolated antibody or antigen binding fragment thereof" refers to an antibody or antigen binding fragment thereof that has been separated from its natural environment and/or that is derived from a natural, synthetic, semi-synthetic, or recombinant source. Illustrative examples of antigen binding fragments contemplated in particular embodiments herein include, but are not limited to, a Llama Ig, a Fab' fragment, a F(ab')2 fragment, a bispecific Fab dimer (Fab2), a trispecific Fab trimer (Fab3), an Fv, a single chain Fv protein ("scFv"), a bis-scFv, $(scFv)_2$, a minibody, a diabody, a triabody, a tetrabody, a disulfide stabilized Fv protein ("dsFv"), and a single-domain antibody (sdAb or NANOBODY® molecule, e.g., a camelid VHH) other portions of full length antibodies sufficient for antigen binding, and combinations thereof.

A "heavy chain antibody" or "hcAb" refers to an antibody that contains two heavy chain variable domains and no light chains. A "camelid antibody" or "camelid Ig" refers to an hcAb isolated from a Camel, Alpaca, or Llama that consists of a homodimer of a heavy chain variable domain (VHH) and CH2 and CH3 constant domains. A "single domain antibody," "sdAb," or NANOBODY® molecule as used herein refers to an antibody fragment that contains the smallest known antigen binding unit of the variable region of a heavy chain antibody, e.g., a camelid VHH. A "humanized VHH" refers to a single domain non-human VHH that has undergone humanization to reduce potential immunogenicity of the antibody in human recipients.

A "single-chain Fv" or "scFv" antibody fragment comprises the VH and VL domains of an antibody, wherein these domains are present in a single polypeptide chain and in either orientation (e.g., VL-VH or VH-VL). Generally, the scFv polypeptide further comprises a polypeptide linker between the VH and VL domains which enables the scFv to form the desired structure for antigen binding.

In particular embodiments, an anti-BCMA antibody or antigen binding fragment thereof comprises a heavy chain variable region (VH) comprising a CDRH1, a CDRH2, and a CDRH3 of an antibody or antigen binding fragment thereof set forth in Table 1; a polypeptide linker; and a light chain variable region (VL) comprising a CDRL1, a CDRL2, and a CDRL3 of an antibody or antigen binding fragment thereof set forth in Table 1.

In particular embodiments, an anti-BCMA antibody or antigen binding fragment thereof comprises in either orientation (e.g., VL-linker-VH or VH-linker-VL): a VH that comprises a CDRH1, a CDRH2, and a CDRH3 comprising the amino acid sequences set forth in SEQ ID NOs: 12, 13, and 14, a polypeptide linker, and a VL that comprises a CDRL1, a CDRL2, and a CDRL3 comprising the amino acid sequences set forth in SEQ ID NOs: 16, 17, and 18; a VH that comprises a CDRH1, a CDRH2, and a CDRH3 comprising the amino acid sequences set forth in SEQ ID NOs: 22, 23, and 24, a polypeptide linker, and a VL that comprises a CDRL1, a CDRL2, and a CDRL3 comprising the amino acid sequences set forth in SEQ ID NOs: 26, 27, and 28; a VH that comprises a CDRH1, a CDRH2, and a CDRH3 comprising the amino acid sequences set forth in SEQ ID NOs: 32, 33, and 34, a polypeptide linker, and a VL that comprises a CDRL1, a CDRL2, and a CDRL3 comprising the amino acid sequences set forth in SEQ ID NOs: 36, 37, and 38; a VH that comprises a CDRH1, a CDRH2, and a CDRH3 comprising the amino acid sequences set forth in SEQ ID NOs: 42, 43, and 44, a polypeptide linker, and a VL that comprises a CDRL1, a CDRL2, and a CDRL3 comprising the amino acid sequences set forth in SEQ ID NOs: 46, 47, and 48; a VH that comprises a CDRH1, a CDRH2, and a CDRH3 comprising the amino acid sequences set forth in SEQ ID NOs: 52, 53, and 54, a polypeptide linker, and a VL that comprises a CDRL1, a CDRL2, and a CDRL3 comprising the amino acid sequences set forth in SEQ ID NOs: 56, 57, and 58; a VH that comprises a CDRH1, a CDRH2, and a CDRH3 comprising the amino acid sequences set forth in SEQ ID NOs: 62, 63, and 64, a polypeptide linker, and a VL that comprises a CDRL1, a CDRL2, and a CDRL3 comprising the amino acid sequences set forth in SEQ ID NOS: 66, 67, and 68; a VH that comprises a CDRH1, a CDRH2, and a CDRH3 comprising the amino acid sequences set forth in SEQ ID NOs: 72, 73, and 74, a polypeptide linker, and a VL that comprises a CDRL1, a CDRL2, and a CDRL3 comprising the amino acid sequences set forth in SEQ ID NOs: 76, 77, and 78; a VH that comprises a CDRH1, a CDRH2, and a CDRH3 comprising the amino acid sequences set forth in SEQ ID NOs: 82, 83, and 84, a polypeptide linker, and a VL that comprises a CDRL1, a CDRL2, and a CDRL3 comprising the amino acid sequences set forth in SEQ ID NOs: 86, 87, and 88; and a VH that comprises a CDRH1, a CDRH2, and a CDRH3 comprising the amino acid sequences set forth in SEQ ID NOs: 92, 93, and 94, a polypeptide linker, and a VL that comprises a CDRL1, a CDRL2, and a CDRL3 comprising the amino acid sequences set forth in SEQ ID NOs: 96, 97, and 98. In particular embodiments, the polypeptide linker is selected from the group consisting of: $(GGGGS)_n$ wherein n=1, 2, 3, 4 or 5 (SEQ ID NOs: 3, and 976-979); GEGTSTGSGGSGGSGGAD (SEQ ID NO: 9), GSTSGSGKPGSGEGSTKG (SEQ ID NO: 10) and variants thereof comprising an amino acid sequence at least 90% identical thereto.

In particular embodiments, an anti-BCMA antibody or antigen binding fragment thereof comprises in either orientation (e.g., VL-linker-VH or VH-linker-VL): a VH that comprises the amino acid sequence set forth in SEQ ID NO: 11; a polypeptide linker; and a VL that comprises the amino acid sequence set forth in SEQ ID NO: 15; wherein the polypeptide linker is selected from the group consisting of: $(GGGGS)_n$ wherein n=1, 2, 3, 4 or 5 (SEQ ID NOs: 3, and 976-979), GEGTSTGSGGSGGSGGAD (SEQ ID NO: 9), GSTSGSGKPGSGEGSTKG (SEQ ID NO: 10) and variants thereof comprising an amino acid sequence 95% identical thereto.

In particular embodiments, an anti-BCMA antibody or antigen binding fragment thereof comprises in either orientation (e.g., VL-linker-VH or VH-linker-VL): a VH that comprises the amino acid sequence set forth in SEQ ID NO: 21; a polypeptide linker; and a VL that comprises the amino acid sequence set forth in SEQ ID NO: 25; wherein the polypeptide linker is selected from the group consisting of: $(GGGGS)_n$ wherein n=1, 2, 3, 4 or 5 (SEQ ID NOs: 3, and 976-979), GEGTSTGSGGSGGSGGAD (SEQ ID NO: 9), GSTSGSGKPGSGEGSTKG (SEQ ID NO: 10) and variants thereof comprising an amino acid sequence 95% identical thereto.

In particular embodiments, an anti-BCMA antibody or antigen binding fragment thereof comprises in either orientation (e.g., VL-linker-VH or VH-linker-VL): a VH that comprises the amino acid sequence set forth in SEQ ID NO: 31; a polypeptide linker; and a VL that comprises the amino acid sequence set forth in SEQ ID NO: 35; wherein the polypeptide linker is selected from the group consisting of: $(GGGGS)_n$ wherein n=1, 2, 3, 4 or 5 (SEQ ID NOs: 3, and 976-979), GEGTSTGSGGSGGSGGAD (SEQ ID NO: 9), GSTSGSGKPGSGEGSTKG (SEQ ID NO: 10) and variants thereof comprising an amino acid sequence 95% identical thereto.

In particular embodiments, an anti-BCMA antibody or antigen binding fragment thereof comprises in either orientation (e.g., VL-linker-VH or VH-linker-VL): a VH that comprises the amino acid sequence set forth in SEQ ID NO: 41; a polypeptide linker; and a VL that comprises the amino acid sequence set forth in SEQ ID NO: 45; wherein the polypeptide linker is selected from the group consisting of: $(GGGGS)_n$ wherein n=1, 2, 3, 4 or 5 (SEQ ID NOs: 3, and 976-979), GEGTSTGSGGSGGSGGAD (SEQ ID NO: 9), GSTSGSGKPGSGEGSTKG (SEQ ID NO: 10) and variants thereof comprising an amino acid sequence 95% identical thereto.

In particular embodiments, an anti-BCMA antibody or antigen binding fragment thereof comprises in either orientation (e.g., VL-linker-VH or VH-linker-VL): a VH that comprises the amino acid sequence set forth in SEQ ID NO: 51; a polypeptide linker; and a VL that comprises the amino acid sequence set forth in SEQ ID NO: 55; wherein the polypeptide linker is selected from the group consisting of: $(GGGGS)_n$ wherein n=1, 2, 3, 4 or 5 (SEQ ID NOs: 3, and 976-979), GEGTSTGSGGSGGSGGAD (SEQ ID NO: 9), GSTSGSGKPGSGEGSTKG (SEQ ID NO: 10) and variants thereof comprising an amino acid sequence 95% identical thereto.

In particular embodiments, an anti-BCMA antibody or antigen binding fragment thereof comprises in either orientation (e.g., VL-linker-VH or VH-linker-VL): a VH that comprises the amino acid sequence set forth in SEQ ID NO: 61; a polypeptide linker; and a VL that comprises the amino acid sequence set forth in SEQ ID NO: 65; wherein the polypeptide linker is selected from the group consisting of: $(GGGGS)_n$ wherein n=1, 2, 3, 4 or 5 (SEQ ID NOs: 3, and 976-979), GEGTSTGSGGSGGSGGAD (SEQ ID NO: 9), GSTSGSGKPGSGEGSTKG (SEQ ID NO: 10) and variants thereof comprising an amino acid sequence 95% identical thereto.

In particular embodiments, an anti-BCMA antibody or antigen binding fragment thereof comprises in either orientation (e.g., VL-linker-VH or VH-linker-VL): a VH that comprises the amino acid sequence set forth in SEQ ID NO: 71; a polypeptide linker; and a VL that comprises the amino acid sequence set forth in SEQ ID NO: 75; wherein the polypeptide linker is selected from the group consisting of: $(GGGGS)_n$ wherein n=1, 2, 3, 4 or 5 (SEQ ID NOs: 3, and 976-979), GEGTSTGSGGSGGSGGAD (SEQ ID NO: 9), GSTSGSGKPGSGEGSTKG (SEQ ID NO: 10) and variants thereof comprising an amino acid sequence 95% identical thereto.

In particular embodiments, an anti-BCMA antibody or antigen binding fragment thereof comprises in either orientation (e.g., VL-linker-VH or VH-linker-VL): a VH that comprises the amino acid sequence set forth in SEQ ID NO: 81; a polypeptide linker; and a VL that comprises the amino acid sequence set forth in SEQ ID NO: 85; wherein the polypeptide linker is selected from the group consisting of: $(GGGGS)_n$ wherein n=1, 2, 3, 4 or 5 (SEQ ID NOs: 3, and 976-979), GEGTSTGSGGSGGSGGAD (SEQ ID NO: 9), GSTSGSGKPGSGEGSTKG (SEQ ID NO: 10) and variants thereof comprising an amino acid sequence 95% identical thereto.

In particular embodiments, an anti-BCMA antibody or antigen binding fragment thereof comprises in either orientation (e.g., VL-linker-VH or VH-linker-VL): a VH that comprises the amino acid sequence set forth in SEQ ID NO: 91; a polypeptide linker; and a VL that comprises the amino acid sequence set forth in SEQ ID NO: 95; wherein the polypeptide linker is selected from the group consisting of: $(GGGGS)_n$ wherein n=1, 2, 3, 4 or 5 (SEQ ID NOs: 3, and 976-979), GEGTSTGSGGSGGSGGAD (SEQ ID NO: 9), GSTSGSGKPGSGEGSTKG (SEQ ID NO: 10) and variants thereof comprising an amino acid sequence 95% identical thereto.

In particular embodiments, an anti-BCMA antibody or antigen binding fragment thereof comprises the amino acid sequence set forth in any one of SEQ ID NOs: 19, 20, 29, 30, 39, 40, 49, 50, 59, 60, 69, 70, 79, 80, 89, 90, 99, and 100 or an amino acid sequence with at least 85%, at least 90%, at least 91%, at least 92%, at least 93%, at least 94%, at least 95%, at least 96%, at least 97%, at least 98%, at least 99% identity thereto.

In particular embodiments, an anti-BCMA antibody or antigen binding fragment thereof comprises a VHH domain comprising a CDRH1, a CDRH2, and a CDRH3 of an antibody or antigen binding fragment thereof set forth in Table 1.

In particular embodiments, an anti-BCMA antibody or antigen binding fragment thereof comprises: a VHH domain that comprises a CDRH1, a CDRH2, and a CDRH3 comprising the amino acid sequences set forth in SEQ ID NOs: 102, 103, and 104; a VHH domain that comprises a CDRH1, a CDRH2, and a CDRH3 comprising the amino acid sequences set forth in SEQ ID NOs: 106, 107, and 108; a VHH domain that comprises a CDRH1, a CDRH2, and a CDRH3 comprising the amino acid sequences set forth in SEQ ID NOs: 110, 111, and 112; a VHH domain that comprises a CDRH1, a CDRH2, and a CDRH3 comprising the amino acid sequences set forth in SEQ ID NOs: 114, 115, and 116; a VHH domain that comprises a CDRH1, a CDRH2, and a CDRH3 comprising the amino acid sequences set forth in SEQ ID NOs: 118, 119, and 120; a VHH domain that comprises a CDRH1, a CDRH2, and a CDRH3 comprising the amino acid sequences set forth in SEQ ID NOs: 122, 123, and 124; a VHH domain that comprises a CDRH1, a CDRH2, and a CDRH3 comprising the amino acid sequences set forth in SEQ ID NOs: 126, 127, and 128; a VHH domain that comprises a CDRH1, a CDRH2, and a CDRH3 comprising the amino acid sequences set forth in SEQ ID NOs: 130, 131, and 132; a VHH domain that comprises a CDRH1, a CDRH2, and a CDRH3 comprising the amino acid sequences set forth in SEQ ID NOs: 134, 135, and 136; a VHH domain that comprises a CDRH1, a CDRH2, and a CDRH3 comprising the amino acid sequences set forth in SEQ ID NOs: 138, 139, and 140; or a VHH domain that comprises a CDRH1, a CDRH2, and a CDRH3 comprising the amino acid sequences set forth in SEQ ID NOs: 142, 143, and 144.

In particular embodiments, an anti-BCMA antibody or antigen binding fragment thereof comprises a VHH that comprises the amino acid sequence set forth in any one of SEQ ID NOS: 101, 105, 109, 113, 117, 121, 125, 129, 133, 137, and 141 or an amino acid sequence with at least 85%, at least 90%, at least 91%, at least 92%, at least 93%, at least 94%, at least 95%, at least 96%, at least 97%, at least 98%, at least 99% identity thereto.

TABLE 1

| AB ID | SEQ ID NO | ID | AMINO ACID SEQUENCE |
|---|---|---|---|
| BCMA.1 | 11 | VH | QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSS |
| | 12 | CDRH1 | TSGVGVG |
| | 13 | CDRH2 | LIYWNDEKRYSPSLKS |
| | 14 | CDRH3 | DEYGGFDI |
| | 15 | VL | EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIK |
| | 16 | CDRL1 | RASQSVSSYLA |
| | 17 | CDRL2 | DASNRAT |
| | 18 | CDRL3 | QQRVVYPIT |
| | 19 | scFv | QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIK |
| | 20 | scFv | EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSS |
| BCMA.2 | 21 | VH | QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSS |
| | 22 | CDRH1 | TSGVGVG |
| | 23 | CDRH2 | LIYWNDDKRYSPSLKS |
| | 24 | CDRH3 | DEYGGFDI |
| | 25 | VL | EIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIK |
| | 26 | CDRL1 | RASQSVSSYLA |
| | 27 | CDRL2 | DASNRAT |
| | 28 | CDRL3 | QQRFDYPIT |
| | 29 | scFv | QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIK |
| | 30 | scFv | EIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKGGGGSGGGGSGGGGSGGGGSQITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSS |
| BCMA.3 | 31 | VH | QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSS |
| | 32 | CDRH1 | SYGMH |
| | 33 | CDRH2 | VISYEGSNKYYADSVKG |
| | 34 | CDRH3 | ELGDGMDV |
| | 35 | VL | EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIK |
| | 36 | CDRL1 | RASQSVSSYLA |
| | 37 | CDRL2 | DASNRAT |
| | 38 | CDRL3 | QQRVDLWT |
| | 39 | scFv-ok | QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSGGGGSGGGGSGGGGSGGGGSEIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIK |

TABLE 1-continued

| AB ID | SEQ ID NO | ID | AMINO ACID SEQUENCE |
|---|---|---|---|
| | 40 | scFv | EIVLTQSPATLSLSPGERATLSCRASQSVSSYLAWFQQKPGQAP RLLIYDASNRATGIPARFSGSGSGTDFTLTISSLEPEDFAVYYC QQRVDLWTFGGGTKVEIKGGGGSGGGGSGGGGSGGGGSQVQLVE SGGGVVQPGRSLRLSCAASGFTFSSYGMHWVRQAPGKGLEWVAV ISYEGSNKYYADSVKGRFTISRDNSKNTLYLQMNSLRAEDTAVY YCARELGDGMDVWGQGTTVTVSS |
| BCMA.4 | 41 | VH | EVQLVESGGGLVKPGGSLRLSCAASGFTFSDYYMSWIRQAPGKG LEWVSYISSSGSTIYYADSVKGRFTISRDNAKNSLYLQMNSLRA EDTAVYYCARDQGNYGVDVWGQGTTVTVSS |
| | 42 | CDRH1 | DYYMS |
| | 43 | CDRH2 | YISSSGSTIYYADSVKG |
| | 44 | CDRH3 | DQGNYGVDV |
| | 45 | VL | DIQMTQSPSTLSASVGDRVTITCRASQSISSWLAWYQQKPGKAP KLLIYDASSLESGVPSRFSGSGSGTEFTLTISSLQPDDFATYYC QQVSSLPPTFGGGTKVEIK |
| | 46 | CDRL1 | RASQSISSWLA |
| | 47 | CDRL2 | DASSLES |
| | 48 | CDRL3 | QQVSSLPPT |
| | 49 | scFv | EVQLVESGGGLVKPGGSLRLSCAASGFTFSDYYMSWIRQAPGKG LEWVSYISSSGSTIYYADSVKGRFTISRDNAKNSLYLQMNSLRA EDTAVYYCARDQGNYGVDVWGQGTTVTVSSGGGGSGGGGSGGGG SGGGGSDIQMTQSPSTLSASVGDRVTITCRASQSISSWLAWYQQ KPGKAPKLLIYDASSLESGVPSRFSGSGSGTEFTLTISSLQPDD FATYYCQQVSSLPPTFGGGTKVEIK |
| | 50 | scFv | DIQMTQSPSTLSASVGDRVTITCRASQSISSWLAWYQQKPGKAP KLLIYDASSLESGVPSRFSGSGSGTEFTLTISSLQPDDFATYYC QQVSSLPPTFGGGTKVEIKGGGGSGGGGSGGGGSGGGGSEVQLV ESGGGLVKPGGSLRLSCAASGFTFSDYYMSWIRQAPGKGLEWVS YISSSGSTIYYADSVKGRFTISRDNAKNSLYLQMNSLRAEDTAV YYCARDQGNYGVDVWGQGTTVTVSS |
| BCMA.5 | 51 | VH | QVQLVESGGGLVKPGGSLRLSCAASGFTFSDYYMSWIRQAPGKG LEWVSYISSSGSTIYYADSVKGRFTISRDNAKNSLYLQMNSLRA EDTAVYYCARDQGNYGVDVWGQGTTVTVSS |
| | 52 | CDRH1 | DYYMS |
| | 53 | CDRH2 | YISSSGSTIYYADSVKG |
| | 54 | CDRH3 | DQGNYGVDV |
| | 55 | VL | DIQMTQSPSTLSASVGDRVTITCRASQSISSWLAWYQQKPGKAP KLLIYEASSLESGVPSRFSGSGSGTEFTLTISSLQPDDFATYYC QQSDSHPITFGGGTKVEIK |
| | 56 | CDRL1 | RASQSISSWLA |
| | 57 | CDRL2 | EASSLES |
| | 58 | CDRL3 | QQSDSHPIT |
| | 59 | scFv-ok | QVQLVESGGGLVKPGGSLRLSCAASGFTFSDYYMSWIRQAPGKG LEWVSYISSSGSTIYYADSVKGRFTISRDNAKNSLYLQMNSLRA EDTAVYYCARDQGNYGVDVWGQGTTVTVSSGGGGSGGGGSGGGG SGGGGSDIQMTQSPSTLSASVGDRVTITCRASQSISSWLAWYQQ KPGKAPKLLIYEASSLESGVPSRFSGSGSGTEFTLTISSLQPDD FATYYCQQSDSHPITFGGGTKVEIK |
| | 60 | scFv | DIQMTQSPSTLSASVGDRVTITCRASQSISSWLAWYQQKPGKAP KLLIYEASSLESGVPSRFSGSGSGTEFTLTISSLQPDDFATYYC QQSDSHPITFGGGTKVEIKGGGGSGGGGSGGGGSGGGGSQVQLV ESGGGLVKPGGSLRLSCAASGFTFSDYYMSWIRQAPGKGLEWVS YISSSGSTIYYADSVKGRFTISRDNAKNSLYLQMNSLRAEDTAV YYCARDQGNYGVDVWGQGTTVTVSS |
| BCMA.6 | 61 | VH | EVQLVESGGGLVKPGGSLRLSCAASGFTFSDYYMSWIRQAPGKG LEWVSYISSSGSTIYYADSVKGRFTISRDNAKNSLYLQMNSLRA EDTAVYYCARDQGNYGVDVWGQGTTVTVSS |
| | 62 | CDRH1 | DYYMS |
| | 63 | CDRH2 | YISSSGSTIYYADSVKG |
| | 64 | CDRH3 | DQGNYGVDV |
| | 65 | VL | DIQMTQSPSTLSASVGDRVTITCRASQSISSWLAWYQQKPGKAP KLLIYEASSLESGVPSRFSGSGSGTEFTLTISSLQPDDFATYYC QQANSHPITFGGGTKVEIK |
| | 66 | CDRL1 | RASQSISSWLA |
| | 67 | CDRL2 | EASSLES |
| | 68 | CDRL3 | QQANSHPIT |
| | 69 | scFv | EVQLVESGGGLVKPGGSLRLSCAASGFTFSDYYMSWIRQAPGKG LEWVSYISSSGSTIYYADSVKGRFTISRDNAKNSLYLQMNSLRA EDTAVYYCARDQGNYGVDVWGQGTTVTVSSGGGGSGGGGSGGGG SGGGGSDIQMTQSPSTLSASVGDRVTITCRASQSISSWLAWYQQ KPGKAPKLLIYEASSLESGVPSRFSGSGSGTEFTLTISSLQPDD FATYYCQQANSHPITFGGGTKVEIK |

TABLE 1-continued

| AB ID | SEQ ID NO | ID | AMINO ACID SEQUENCE |
|---|---|---|---|
| | 70 | scFv-ok | DIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSS |
| BCMA.7 | 71 | VH | EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSS |
| | 72 | CDRH1 | NYAMS |
| | 73 | CDRH2 | AISGSGGSTYYADSVKG |
| | 74 | CDRH3 | PGDGYYEGVYFDY |
| | 75 | VL | DIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIK |
| | 76 | CDRL1 | RASQSISSYLN |
| | 77 | CDRL2 | AASSLQS |
| | 78 | CDRL3 | QQAHSSPIT |
| | 79 | scFv | EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIK |
| | 80 | scFv | DIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKGGGGSGGGGSGGGGSGGGGSEVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSS |
| BCMA.8 | 81 | VH | QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSS |
| | 82 | CDRH1 | TSGVGVG |
| | 83 | CDRH2 | LIYWNDEKRYSPSLKS |
| | 84 | CDRH3 | EGSHDYKSSNWFDP |
| | 85 | VL | DIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIK |
| | 86 | CDRL1 | QASQDIANYLN |
| | 87 | CDRL2 | DASNLET |
| | 88 | CDRL3 | QQHFNLPLTF |
| | 89 | scFv | QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSGGGGSGGGSGGGGSGGGGSDIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIK |
| | 90 | scFv-ok | DIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSS |
| BCMA.9 | 91 | VH | EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSS |
| | 92 | CDRH1 | SYSMN |
| | 93 | CDRH2 | SISSSSSYIYYADSVKG |
| | 94 | CDRH3 | AGDTYSAADYYYMDV |
| | 95 | VL | DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIK |
| | 96 | CDRL1 | RSSQSLLHSNGYNYLD |
| | 97 | CDRL2 | LGSNRAS |
| | 98 | CDRL3 | MQALGLIT |
| | 99 | scFv | EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIK |

TABLE 1-continued

| AB ID | SEQ ID NO | ID | AMINO ACID SEQUENCE |
|---|---|---|---|
| | 100 | scFv | DIVMTQSPLSLPVTPGEPASISCRSSQSLLHSNGYNYLDWYLQK PGQSPQLLIYLGSNRASGVPDRFSGSGSGTDFTLKISRVEAEDV GVYYCMQALGLITFGGGTKVEIKGGGGSGGGGSGGGGSGGGGSE VQLVESGGGLVKPGGSLRLSCAASGFTFSSYSMNWVRQAPGKGL EWVSSISSSSSYIYYADSVKGRFTISRDNAKNSLYLQMNSLRAE DTAVYYCARAGDTYSAADYYYMDVWGKGTTVTVSS |
| BCMA.10 | 101 | VHH-ok | EVQLLESGGGLVQPGGSLRLSCAASGFTFGSEAMSWVRQAPGKE RELVSAISGSGEVTYYADSVKGRFTISRDNSKNTLYLQMNSLRA EDTAVYYCQRLVEAKRHWGQGTQVTVSS |
| | 102 | CDRH1 | SEAMS |
| | 103 | CDRH2 | AISGSGEVTYYADSVKG |
| | 104 | CDRH3 | LVEAKRH |
| BCMA.11 | 105 | VHH | EVQLLESGGGLVQPGGSLRLSCAASGFTFESEAMSWYRQAPGKE RELVSVITSEGSTYYADSVKGRFTISRDNSKNTLYLQMNSLRAE DTAVYYCAHIEWETRLNWGQGTQVTVSS |
| | 106 | CDRH1 | SEAMS |
| | 107 | CDRH2 | VITSEGSTYYADSVKG |
| | 108 | CDRH3 | IEWETRLN |
| BCMA.12 | 109 | VHH | EVQLLESGGGLVQPGGSLRLSCAASGFTFDEYTMHWFRQAPGKE REFVSAISGGGSETYYADSVKGRFTISRDNSKNTLYLQMNSLRA EDTAVYYCAAGGEEAGVGYWGQGTQVTVSS |
| | 110 | CDRH1 | EYTMH |
| | 111 | CDRH2 | AISGGGSETYYADSVKG |
| | 112 | CDRH3 | GGEEAGVGY |
| BCMA.13 | 113 | VHH | EVQLLESGGGLVQPGGSLRLSCAASGFTFEDYAMSWFRQAPGKE REGVSAISGKGGSTYYADSVKGRFTISRDNSKNTLYLQMNSLRA EDTAVYYCAVLDEEAGAEGGYWGQGTQVTVSS |
| | 114 | CDRH1 | DYAMS |
| | 115 | CDRH2 | AISGKGGSTYYADSVKG |
| | 116 | CDRH3 | LDEEAGAEGGY |
| BCMA.14 | 117 | VHH-ok | EVQLLESGGGLVQPGGSLRLSCAASGFTFDRYAMSWFRQAPGKE REGVSAISTSGDSTYYADSVKGRFTISRDNSKNTLYLQMNSLRA EDTAVYYCAVLDEEAGAEGGYWGQGTQVTVSS |
| | 118 | CDRH1 | RYAMS |
| | 119 | CDRH2 | AISTSGDSTYYADSVKG |
| | 120 | CDRH3 | LDEEAGAEGGY |
| BCMA.15 | 121 | VHH | EVQLLESGGGLVQPGGSLRLSCAASGFTFASDAMSWYRQAPGKE RELVSAISGSGGSTYYADSVKGRFTISRDNSKNTLYLQMNSLRA EDTAVYYCAAHDSGEAYLAFDYWGQGTQVTVSS |
| | 122 | CDRH1 | SDAMS |
| | 123 | CDRH2 | AISGSGGSTYYADSVKG |
| | 124 | CDRH3 | HDSGEAYLAFDY |
| BCMA.16 | 125 | VHH | EVQLLESGGGLVQPGGSLRLSCAASGFTFDSYTMSWYRQAPGKE RELVSAISGHGDSTYYADSVKGRFTISRDNSKNTLYLQMNSLRA EDTAVYYCTRISITTEWLAGDYWGQGTQVTVSS |
| | 126 | CDRH1 | SYTMS |
| | 127 | CDRH2 | AISGHGDSTYYADSVKG |
| | 128 | CDRH3 | ISITTEWLAGDY |
| BCMA.17 | 129 | VHH | EVQLLESGGGLVQPGGSLRLSCAASGFTFSSYAMSWFRQAPGKE REFVSFISGSGDSTYYADSVKGRFTISRDNSKNTLYLQMNSLRA EDTAVYYCTRWPYDFEEPSEPGVYWGQGTQVTVSS |
| | 130 | CDRH1 | SYAMS |
| | 131 | CDRH2 | FISGSGDSTYYADSVKG |
| | 132 | CDRH3 | WPYDFEEPSEPGVY |
| BCMA.18 | 133 | VHH | EVQLLESGGGLVQPGGSLRLSCAASGFTFTDYDMSWYRQAPGKE RELVSVIHSGGSTYYADSVKGRFTISRDNSKNTLYLQMNSLRAE DTAVYYCAPGYYSDLSFDYYNFDYWGQGTQVTVSS |
| | 134 | CDRH1 | DYDMS |
| | 135 | CDRH2 | VIHSGGSTYYADSVKG |
| | 136 | CDRH3 | GYYSDLSFDYYNFDY |
| BCMA.19 | 137 | VHH | EVQLLESGGGLVQPGGSLRLSCAASGFTFSDYAMHWFRQAPGKE RVLVSSIDSGGSTYYADSVKGRFTISRDNSKNTLYLQMNSLRAE DTAVYYCNAGFKGDHPHPKDAFDIWGQGTQVTVSS |
| | 138 | CDRH1 | DYAMH |
| | 139 | CDRH2 | SIDSGGSTYYADSVKG |
| | 140 | CDRH3 | GFKGDHPHPKDAFDI |

TABLE 1-continued

| AB ID | SEQ ID NO | ID | AMINO ACID SEQUENCE |
|---|---|---|---|
| BCMA.20 | 141 | VHH | EVQLLESGGGLVQPGGSLRLSCAASGFTFSSEGMSWVRQAPGKE RELVSAISGSGDHTYYADSVRGRFTISRDNSKNTLYLQMNSLRA EDTAVYYCNALEGGPTTAIQPGGPDYWGQGTQVTVSS |
| | 142 | CDRH1 | SEGMS |
| | 143 | CDRH2 | AISGSGDHTYYADSVRG |
| | 144 | CDRH3 | LEGGPTTAIQPGGPDY |

In particular embodiments, an anti-BCMA antibody or antigen binding fragment thereof comprising an amino acid sequence set forth in Table 1 is conjugated to a cytotoxic agent. In some embodiments, a cytotoxic agent is selected from the group consisting of: a toxin, a radioisotope, an RNA polymerase II inhibitor and/or RNA polymerase III inhibitor, and a DNA-damaging agent.

In particular embodiments, an anti-BCMA antibody or antigen binding fragment thereof comprising an amino acid sequence set forth in Table 1 is conjugated to a cytotoxic agent that comprises a toxin. Illustrative examples of toxins contemplated in particular embodiments include but are not limited to saporin, diphtheria toxin, *pseudomonas* exotoxin A, Ricin A chain derivatives, a small molecule toxin, and combinations thereof.

In particular embodiments, an anti-BCMA antibody or antigen binding fragment thereof comprising an amino acid sequence set forth in Table 1 is conjugated to a cytotoxic agent that comprises a radioisotope. Illustrative examples of radioisotopes contemplated in particular embodiments include but are not limited to $^{131}$I, $^{90}$Y, $^{177}$Lu, $^{188}$Re, $^{67}$Cu, $^{213}$Bi, $^{211}$ At, and $^{227}$ Ac.

In particular embodiments, an anti-BCMA antibody or antigen binding fragment thereof comprising an amino acid sequence set forth in Table 1 is conjugated to a cytotoxic agent that comprises an RNA polymerase II and/or III inhibitor. Illustrative examples of RNA polymerase II and/or III inhibitors contemplated in particular embodiments include but are not limited to an amatoxin, including without limitation, α-amanitin, β-amanitin, γ-amanitin, ε-amanitin, amanin, amaninamide, amanullin, amanullinic acid and any functional fragments, derivatives or analogs thereof.

In particular embodiments, an anti-BCMA antibody or antigen binding fragment thereof comprising an amino acid sequence set forth in Table 1 is conjugated to a cytotoxic agent that comprises a DNA-damaging agent. Illustrative examples of DNA-damaging agents contemplated in particular embodiments include but are not limited to an antitubulin agent, a DNA crosslinking agent, a DNA alkylating agent and a mitotic disrupting agent.

D. Chimeric Antigen Receptors

Chimeric antigen receptors (CARs) are fusion polypeptides that exploit antibody-based specificity for a desired antigen (e.g., BCMA) to redirect immune effector cell specificity, thereby triggering proliferation, cytokine production, phagocytosis or production of molecules that can mediate cell death of the target antigen expressing cell in a major histocompatibility (MHC) independent manner. As used herein, the term "chimeric" refers to a molecule that is composed of two or more polypeptides, or polynucleotides, of different origins.

The present disclosure contemplates improved anti-BCMA CARs that are suitable for in vivo modification, or ex vivo manufacture, of immune effector cells to redirect cytotoxicity toward BCMA-expressing cells (e.g., B cells). In various embodiments, a CAR comprises a binding domain comprising one or more antibodies or antigen binding fragments thereof that binds to BCMA, a spacer domain, a transmembrane domain, and one or more intracellular signaling domains. In particular embodiments, a CAR comprises an antibody or antigen binding fragment thereof that binds to BCMA, a spacer domain, a transmembrane domain, and a primary signaling domain. In particular embodiments, a CAR comprises an antibody or antigen binding fragment thereof that binds to BCMA, a spacer domain, a transmembrane domain, one or more costimulatory signaling domains, and a primary signaling domain.

Illustrative examples of chimeric antigen receptor polypeptides are set forth in SEQ ID NOs: 165-860 and illustrative examples of polynucleotides encoding chimeric antigen receptor polypeptides are set forth in SEQ ID NOs: 905-944.

1. Binding Domains

In particular embodiments, a CAR comprises an extracellular antigen binding domain that comprises an antibody or antigen binding fragment thereof that specifically binds to a human BCMA polypeptide. The term "binding domain" or "extracellular antigen binding domain" are used interchangeably and refer to one or more antibodies or antigen binding fragments thereof that bind BCMA. The binding domain may be derived either from a natural, synthetic, semi-synthetic, or recombinant source.

In particular embodiments, a CAR comprises a binding domain that comprises one or more single chain variable fragments (scFv) and/or VHH domains that bind BCMA. In particular embodiments, a CAR comprises a binding domain that comprises one or more scFvs that bind BCMA. In particular embodiments, a CAR comprises a binding domain that comprises one or more VHH domains that bind BCMA.

In particular embodiments, a CAR comprises an anti-BCMA antibody or antigen binding fragment thereof comprising a heavy chain variable region (VH) that comprises a CDRH1, a CDRH2, and a CDRH3 of an antibody or antigen binding fragment thereof set forth in Table 1; a polypeptide linker; and a light chain variable region (VL) that comprises a CDRL1, a CDRL2, and a CDRL3 of an antibody or antigen binding fragment thereof set forth in Table 1; a spacer domain; a transmembrane domain; a costimulatory signaling domain; and a primary signaling domain.

In particular embodiments, a CAR comprises an anti-BCMA antibody or antigen binding fragment thereof in either orientation (e.g., VL-linker-VH or VH-linker-VL) comprising a VH that comprises a CDRH1, a CDRH2, and a CDRH3 comprising the amino acid sequences set forth in SEQ ID NOs: 12, 13, and 14; a polypeptide linker; and a VL that comprises a CDRL1, a CDRL2, and a CDRL3 comprising the amino acid sequences set forth in SEQ ID NOs: 16, 17, and 18; a spacer domain; a transmembrane domain;

a costimulatory signaling domain; and a primary signaling domain. In particular embodiments, a CAR comprises an anti-BCMA antibody or antigen binding fragment thereof in either orientation (e.g., VL-linker-VH or VH-linker-VL) comprising a VH that comprises a CDRH1, a CDRH2, and a CDRH3 comprising the amino acid sequences set forth in SEQ ID NOs: 22, 23, and 24, a polypeptide linker, and a VL that comprises a CDRL1, a CDRL2, and a CDRL3 comprising the amino acid sequences set forth in SEQ ID NOs: 26, 27, and 28; a spacer domain; a transmembrane domain; a costimulatory signaling domain; and a primary signaling domain. In particular embodiments, a CAR comprises an anti-BCMA antibody or antigen binding fragment thereof in either orientation (e.g., VL-linker-VH or VH-linker-VL) comprising a VH that comprises a CDRH1, a CDRH2, and a CDRH3 comprising the amino acid sequences set forth in SEQ ID NOs: 32, 33, and 34, a polypeptide linker, and a VL that comprises a CDRL1, a CDRL2, and a CDRL3 comprising the amino acid sequences set forth in SEQ ID NOS: 36, 37, and 38; a spacer domain; a transmembrane domain; a costimulatory signaling domain; and a primary signaling domain. In particular embodiments, a CAR comprises an anti-BCMA antibody or antigen binding fragment thereof in either orientation (e.g., VL-linker-VH or VH-linker-VL) comprising a VH that comprises a CDRH1, a CDRH2, and a CDRH3 comprising the amino acid sequences set forth in SEQ ID NOs: 42, 43, and 44, a polypeptide linker, and a VL that comprises a CDRL1, a CDRL2, and a CDRL3 comprising the amino acid sequences set forth in SEQ ID NOS: 46, 47, and 48; a spacer domain; a transmembrane domain; a costimulatory signaling domain; and a primary signaling domain. In particular embodiments, a CAR comprises an anti-BCMA antibody or antigen binding fragment thereof in either orientation (e.g., VL-linker-VH or VH-linker-VL) comprising a VH that comprises a CDRH1, a CDRH2, and a CDRH3 comprising the amino acid sequences set forth in SEQ ID NOs: 52, 53, and 54, a polypeptide linker, and a VL that comprises a CDRL1, a CDRL2, and a CDRL3 comprising the amino acid sequences set forth in SEQ ID NOs: 56, 57, and 58; a spacer domain; a transmembrane domain; a costimulatory signaling domain; and a primary signaling domain. In particular preferred embodiments, a CAR comprises an anti-BCMA antibody or antigen binding fragment thereof in either orientation (e.g., VL-linker-VH or VH-linker-VL) comprising a VH that comprises a CDRH1, a CDRH2, and a CDRH3 comprising the amino acid sequences set forth in SEQ ID NOs: 62, 63, and 64, a polypeptide linker, and a VL that comprises a CDRL1, a CDRL2, and a CDRL3 comprising the amino acid sequences set forth in SEQ ID NOs: 66, 67, and 68; a spacer domain; a transmembrane domain; a costimulatory signaling domain; and a primary signaling domain. In particular embodiments, a CAR comprises an anti-BCMA antibody or antigen binding fragment thereof in either orientation (e.g., VL-linker-VH or VH-linker-VL) comprising a VH that comprises a CDRH1, a CDRH2, and a CDRH3 comprising the amino acid sequences set forth in SEQ ID NOs: 72, 73, and 74, a polypeptide linker, and a VL that comprises a CDRL1, a CDRL2, and a CDRL3 comprising the amino acid sequences set forth in SEQ ID NOs: 76, 77, and 78; a spacer domain; a transmembrane domain; a costimulatory signaling domain; and a primary signaling domain. In particular embodiments, a CAR comprises an anti-BCMA antibody or antigen binding fragment thereof in either orientation (e.g., VL-linker-VH or VH-linker-VL) comprising a VH that comprises a CDRH1, a CDRH2, and a CDRH3 comprising the amino acid sequences set forth in SEQ ID NOs: 82, 83, and 84, a polypeptide linker, and a VL that comprises a CDRL1, a CDRL2, and a CDRL3 comprising the amino acid sequences set forth in SEQ ID NOs: 86, 87, and 88; a spacer domain; a transmembrane domain; a costimulatory signaling domain; and a primary signaling domain. In particular embodiments, a CAR comprises an anti-BCMA antibody or antigen binding fragment thereof in either orientation (e.g., VL-linker-VH or VH-linker-VL) comprising a VH that comprises a CDRH1, a CDRH2, and a CDRH3 comprising the amino acid sequences set forth in SEQ ID NOs: 92, 93, and 94, a polypeptide linker, and a VL that comprises a CDRL1, a CDRL2, and a CDRL3 comprising the amino acid sequences set forth in SEQ ID NOs: 96, 97, and 98; a spacer domain; a transmembrane domain; a costimulatory signaling domain; and a primary signaling domain. In particular embodiments, the polypeptide linker is selected from the group consisting of: $(GGGGS)_n$ wherein n=1, 2, 3, 4 or 5 (SEQ ID NOs: 3, and 976-979); GEGTSTGSGGSGGSGGAD (SEQ ID NO: 9), GSTSGSGKPGSGEGSTKG (SEQ ID NO: 10) and variants thereof comprising an amino acid sequence at least 90% identical thereto.

In particular embodiments, a CAR comprises an anti-BCMA antibody or antigen binding fragment thereof in either orientation (e.g., VL-linker-VH or VH-linker-VL) comprising a VH that comprises the amino acid sequence set forth in SEQ ID NO: 11; a polypeptide linker selected from the group consisting of: $(GGGGS)_n$ wherein n=1, 2, 3, 4 or 5 (SEQ ID NOs: 3, and 976-979), GEGTSTGSGGSGGSGGAD (SEQ ID NO: 9), GSTSGSGKPGSGEGSTKG (SEQ ID NO: 10) and variants thereof comprising an amino acid sequence 95% identical thereto; a VL that comprises the amino acid sequence set forth in SEQ ID NO: 15; a spacer domain; a transmembrane domain; a costimulatory signaling domain; and a primary signaling domain.

In particular embodiments, a CAR comprises an anti-BCMA antibody or antigen binding fragment thereof in either orientation (e.g., VL-linker-VH or VH-linker-VL) comprising a VH that comprises the amino acid sequence set forth in SEQ ID NO: 21; a polypeptide linker selected from the group consisting of: $(GGGGS)_n$ wherein n=1, 2, 3, 4 or 5 (SEQ ID NOs: 3, and 976-979), GEGTSTGSGGSGGSGGAD (SEQ ID NO: 9), GSTSGSGKPGSGEGSTKG (SEQ ID NO: 10) and variants thereof comprising an amino acid sequence 95% identical thereto; and a VL that comprises the amino acid sequence set forth in SEQ ID NO: 25; a spacer domain; a transmembrane domain; a costimulatory signaling domain; and a primary signaling domain.

In particular embodiments, a CAR comprises an anti-BCMA antibody or antigen binding fragment thereof in either orientation (e.g., VL-linker-VH or VH-linker-VL) comprising a VH that comprises the amino acid sequence set forth in SEQ ID NO: 31; a polypeptide linker selected from the group consisting of: $(GGGGS)_n$ wherein n=1, 2, 3, 4 or 5 (SEQ ID NOs: 3, and 976-979), GEGTSTGSGGSGGSGGAD (SEQ ID NO: 9), GSTSGSGKPGSGEGSTKG (SEQ ID NO: 10) and variants thereof comprising an amino acid sequence 95% identical thereto; and a VL that comprises the amino acid sequence set forth in SEQ ID NO: 35; a spacer domain; a transmembrane domain; a costimulatory signaling domain; and a primary signaling domain.

In particular embodiments, a CAR comprises an anti-BCMA antibody or antigen binding fragment thereof in either orientation (e.g., VL-linker-VH or VH-linker-VL) comprising a VH that comprises the amino acid sequence set forth in SEQ ID NO: 41; a polypeptide linker selected from the group consisting of: $(GGGGS)_n$ wherein n=1, 2, 3, 4 or 5 (SEQ ID NOs: 3, and 976-979), GEGTSTGSGGSGGSG-GAD (SEQ ID NO: 9), GSTSGSGKPGSGEGSTKG (SEQ ID NO: 10) and variants thereof comprising an amino acid sequence 95% identical thereto; and a VL that comprises the amino acid sequence set forth in SEQ ID NO: 45; a spacer domain; a transmembrane domain; a costimulatory signaling domain; and a primary signaling domain.

In particular embodiments, a CAR comprises an anti-BCMA antibody or antigen binding fragment thereof in either orientation (e.g., VL-linker-VH or VH-linker-VL) comprising a VH that comprises the amino acid sequence set forth in SEQ ID NO: 51; a polypeptide linker selected from the group consisting of: $(GGGGS)_n$ wherein n=1, 2, 3, 4 or 5 (SEQ ID NOs: 3, and 976-979), GEGTSTGSGGSGGSG-GAD (SEQ ID NO: 9), GSTSGSGKPGSGEGSTKG (SEQ ID NO: 10) and variants thereof comprising an amino acid sequence 95% identical thereto; and a VL that comprises the amino acid sequence set forth in SEQ ID NO: 55; a spacer domain; a transmembrane domain; a costimulatory signaling domain; and a primary signaling domain.

In particular embodiments, a CAR comprises an anti-BCMA antibody or antigen binding fragment thereof in either orientation (e.g., VL-linker-VH or VH-linker-VL) comprising a VH that comprises the amino acid sequence set forth in SEQ ID NO: 61; a polypeptide linker selected from the group consisting of: $(GGGGS)_n$ wherein n=1, 2, 3, 4 or 5 (SEQ ID NOs: 3, and 976-979), GEGTSTGSGGSGGSG-GAD (SEQ ID NO: 9), GSTSGSGKPGSGEGSTKG (SEQ ID NO: 10) and variants thereof comprising an amino acid sequence 95% identical thereto; and a VL that comprises the amino acid sequence set forth in SEQ ID NO: 65; a spacer domain; a transmembrane domain; a costimulatory signaling domain; and a primary signaling domain.

In particular embodiments, a CAR comprises an anti-BCMA antibody or antigen binding fragment thereof in either orientation (e.g., VL-linker-VH or VH-linker-VL) comprising a VH that comprises the amino acid sequence set forth in SEQ ID NO: 71; a polypeptide linker selected from the group consisting of: $(GGGGS)_n$ wherein n=1, 2, 3, 4 or 5 (SEQ ID NOs: 3, and 976-979), GEGTSTGSGGSGGSG-GAD (SEQ ID NO: 9), GSTSGSGKPGSGEGSTKG (SEQ ID NO: 10) and variants thereof comprising an amino acid sequence 95% identical thereto; and a VL that comprises the amino acid sequence set forth in SEQ ID NO: 75; a spacer domain; a transmembrane domain; a costimulatory signaling domain; and a primary signaling domain.

In particular embodiments, a CAR comprises an anti-BCMA antibody or antigen binding fragment thereof in either orientation (e.g., VL-linker-VH or VH-linker-VL) comprising a VH that comprises the amino acid sequence set forth in SEQ ID NO: 81; a polypeptide linker selected from the group consisting of: $(GGGGS)_n$ wherein n=1, 2, 3, 4 or 5 (SEQ ID NOs: 3, and 976-979), GEGTSTGSGGSGGSG-GAD (SEQ ID NO: 9), GSTSGSGKPGSGEGSTKG (SEQ ID NO: 10) and variants thereof comprising an amino acid sequence 95% identical thereto; and a VL that comprises the amino acid sequence set forth in SEQ ID NO: 85; a spacer domain; a transmembrane domain; a costimulatory signaling domain; and a primary signaling domain.

In particular embodiments, a CAR comprises an anti-BCMA antibody or antigen binding fragment thereof in either orientation (e.g., VL-linker-VH or VH-linker-VL) comprising a VH that comprises the amino acid sequence set forth in SEQ ID NO: 91; a polypeptide linker selected from the group consisting of: $(GGGGS)_n$ wherein n=1, 2, 3, 4 or 5 (SEQ ID NOs: 3, and 976-979), GEGTSTGSGGSGGSG-GAD (SEQ ID NO: 9), GSTSGSGKPGSGEGSTKG (SEQ ID NO: 10) and variants thereof comprising an amino acid sequence 95% identical thereto; and a VL that comprises the amino acid sequence set forth in SEQ ID NO: 95; a spacer domain; a transmembrane domain; a costimulatory signaling domain; and a primary signaling domain.

In particular embodiments, a CAR comprises an anti-BCMA antibody or antigen binding fragment thereof comprises the amino acid sequence set forth in any one of SEQ ID NOs: 19, 20, 29, 30, 39, 40, 49, 50, 59, 60, 69, 70, 79, 80, 89, 90, 99, and 100 or an amino acid sequence with at least 85%, at least 90%, at least 91%, at least 92%, at least 93%, at least 94%, at least 95%, at least 96%, at least 97%, at least 98%, at least 99% identity thereto; a spacer domain; a transmembrane domain; a costimulatory signaling domain; and a primary signaling domain.

In particular embodiments, a CAR comprises one or more VHH domains that bind BCMA comprising a CDRH1, a CDRH2, and a CDRH3 of an antibody or antigen binding fragment thereof set forth in Table 1; a spacer domain; a transmembrane domain; a costimulatory signaling domain; and a primary signaling domain. In particular embodiments, a CAR comprises a VHH domain that comprises a CDRH1, a CDRH2, and a CDRH3 comprising the amino acid sequences set forth in SEQ ID NOs: 102, 103, and 104; a spacer domain; a transmembrane domain; a costimulatory signaling domain; and a primary signaling domain. In particular embodiments, a CAR comprises a VHH domain that comprises a CDRH1, a CDRH2, and a CDRH3 comprising the amino acid sequences set forth in SEQ ID NOs: 106, 107, and 108; a spacer domain; a transmembrane domain; a costimulatory signaling domain; and a primary signaling domain. In particular embodiments, a CAR comprises a VHH domain that comprises a CDRH1, a CDRH2, and a CDRH3 comprising the amino acid sequences set forth in SEQ ID NOs: 110, 111, and 112; a spacer domain; a transmembrane domain; a costimulatory signaling domain; and a primary signaling domain. In particular embodiments, a CAR comprises a VHH domain that comprises a CDRH1, a CDRH2, and a CDRH3 comprising the amino acid sequences set forth in SEQ ID NOs: 114, 115, and 116; a spacer domain; a transmembrane domain; a costimulatory signaling domain; and a primary signaling domain. In particular embodiments, a CAR comprises a VHH domain that comprises a CDRH1, a CDRH2, and a CDRH3 comprising the amino acid sequences set forth in SEQ ID NOs: 118, 119, and 120; a spacer domain; a transmembrane domain; a costimulatory signaling domain; and a primary signaling domain. In particular embodiments, a CAR comprises a VHH domain that comprises a CDRH1, a CDRH2, and a CDRH3 comprising the amino acid sequences set forth in SEQ ID NOs: 122, 123, and 124; a spacer domain; a transmembrane domain; a costimulatory signaling domain; and a primary signaling domain. In particular embodiments, a CAR comprises a VHH domain that comprises a CDRH1, a CDRH2, and a CDRH3 comprising the amino acid sequences set forth in SEQ ID NOs: 126, 127, and 128; a spacer domain; a transmembrane domain; a costimulatory signaling domain; and a primary signaling domain. In particular embodiments, a CAR comprises a VHH domain that comprises a CDRH1, a CDRH2, and a CDRH3 comprising the amino acid sequences set forth in SEQ ID NOs: 130, 131, and 132; a spacer domain; a transmembrane domain; a costimulatory signaling domain; and a primary signaling domain. In particular embodiments, a CAR comprises a VHH domain that comprises a CDRH1, a CDRH2, and a CDRH3 comprising the amino acid sequences set forth in SEQ ID NOs: 134, 135, and 136; a spacer domain; a transmembrane domain; a costimulatory signaling domain; and a primary signaling domain. In particular embodiments, a CAR comprises a VHH domain that comprises a CDRH1, a CDRH2, and a CDRH3 comprising the amino acid sequences set forth in SEQ ID NOs: 138, 139, and 140; a spacer domain; a transmembrane domain; a costimulatory signaling domain; and a primary signaling domain. In particular embodiments, a CAR comprises a VHH domain that comprises a CDRH1, a CDRH2, and a CDRH3 comprising the amino acid sequences set forth in SEQ ID NOs: 142, 143, and 144 a spacer domain; a transmembrane domain; a costimulatory signaling domain; and a primary signaling domain. In particular embodiments, a CAR comprises one or more VHH domains set forth in SEQ ID NOs: 101, 105, 109, 113, 117, 121, 125, 129, 133, 137, and 141 or an amino acid sequence with at least 85%, at least 90%, at least 91%, at least 92%, at least 93%, at least 94%, at least 95%, at least 96%, at least 97%, at least 98%, or at least 99% identity thereto; a spacer domain; a transmembrane domain; a costimulatory signaling domain; and a primary signaling domain.

2. Spacer Domain

Chimeric antigen receptors contemplated herein comprise a spacer domain. A spacer domain is disposed between the extracellular antigen binding domain and the transmembrane domain of a CAR. A spacer domain plays a role in positioning the extracellular antigen binding domain away from the effector cell surface to enable proper cell/cell contact, antigen binding and activation. A spacer domain may be derived from a hinge domain or stalk domain of a naturally occurring polypeptide or from a synthetic, semi-synthetic, or recombinant source.

In particular embodiments, a CAR comprises a spacer domain comprising a hinge and/or stalk domain isolated from CD4, CD7, CD8a, CD8B, CD28, CD134, CD137, CD152, and CD278, or an amino acid sequence having at least 90%, 91%, 92%, 93%, 94%, 95%, 96%, 97%, 98%, or 99% identity thereto. In particular embodiments, a CAR comprises a spacer domain comprising a naturally occurring immunoglobin hinge region isolated from IgG1, IgG2, IgG3, or IgG4, optionally in combination with one or more heavy chain constant regions, e.g., CH2 and/or CH3.

In particular embodiments, a CAR comprises an antibody or antigen binding fragment thereof comprising an amino acid sequence set forth in Table 1; a spacer domain selected from the group consisting of: a CD4 hinge, a CD8β hinge, a CD8α hinge, a CD28 hinge, a CD134 hinge, a CD137 hinge, a CD152 hinge, a CD278 hinge, an IgG1 hinge, an IgG2 hinge, an IgG3 hinge, and an IgG4 hinge; a transmembrane domain; one or more costimulatory signaling domains; and a primary signaling domain.

In particular embodiments, a CAR comprises an antibody or antigen binding fragment thereof comprising an amino acid sequence set forth in Table 1; a spacer domain comprising an amino acid sequence set forth in Table 2; a transmembrane domain; one or more costimulatory signaling domains; and a primary signaling domain.

TABLE 2

| SEQ ID NO: | AMINO ACID SEQUENCE |
|---|---|
| 145 | TTTPAPRPPTPAPTIASQPLSLRPEACRPAAGGAVHTRGLDFACD |
| 146 | IEVMYPPPYLDNEKSNGTIIHVKGKHLCPSPLFPGPSKP |
| 147 | SGQVLLESNIKVLPTWSTPVQP |
| 148 | ESKYGPPCPPCP |
| 149 | ESKYGPPCPPCPAPPVAGPSVFLFPPKPKDTLMISRTPEVTCVVVDVSQEDPEVQFNWYVDG VEVHNAKTKPREEQFQSTYRVVSVLTVLHQDWLNGKEYKCKVSNKGLPSSIEKTISKAKGQP REPQVYTLPPSQEEMTKNQVSLTCLVKGFYPSDIAVEWESNGQPENNYKTTPPVLDSDGSFF LYSRLTVDKSRWQEGNVFSCSVMHEALHNHYTQKSLSLSLGK |
| 150 | LEPKSCDKTHTCPPCP |

In particular embodiments, a CAR comprises an antibody or antigen binding fragment thereof comprising an amino acid sequence set forth in Table 1; a spacer domain comprising an amino acid sequence set forth in any one of SEQ ID NOs: 145, 146, 147, 148, 149, and 150; a transmembrane domain; one or more costimulatory signaling domains; and a primary signaling domain.

3. Transmembrane Domain

Chimeric antigen receptors contemplated herein comprise a transmembrane domain. The transmembrane domain is a hydrophobic domain that fuses the extracellular and intracellular portions of the CAR and anchors the CAR to the plasma membrane of the immune effector cell. The transmembrane domain may be derived either from a natural, synthetic, semi-synthetic, or recombinant source. In particular embodiments, the CAR further comprises a short oligo- or polypeptide linker, preferably between 1, 2, 3, 4, 5, 6, 7, 8, 9, or 10 amino acids in length disposed between the transmembrane domain and the intracellular domains of the CAR.

In particular embodiments, a CAR comprises an antibody or antigen binding fragment thereof comprising an amino acid sequence set forth in Table 1; a spacer domain; a transmembrane domain isolated or derived from a polypeptide selected from the group consisting of an alpha, beta, gamma, or delta chain of the T-cell receptor, CD3δ, CD3ε, CD3γ, CD3ζ, CD4, CD5, CD8α, CD9, CD16, CD22, CD27, CD28, CD33, CD37, CD45, CD64, CD80, CD86, CD134, CD137, CD152, CD154, CD278, amnionless (AMN), and programmed cell death 1 (PDCD1); one or more costimulatory signaling domains; and a primary signaling domain.

In particular embodiments, a CAR comprises an antibody or antigen binding fragment thereof comprising an amino acid sequence set forth in Table 1; a spacer domain; a transmembrane domain comprising an amino acid sequence set forth in Table 3; one or more costimulatory signaling domains; and a primary signaling domain.

TABLE 3

| SEQ ID NO: | AMINO ACID SEQUENCE |
|---|---|
| 151 | IYIWAPLAGTCGVLLLSLVITLYC |
| 152 | IISFFLALTSTALLFLLFFLTLRFSVV |
| 153 | FWVLVVVGGVLACYSLLVTVAFIIFWV |
| 154 | VAAILGLGLVLGLLGPLAILL |
| 155 | WLPIGCAAFVVVCILGCILICWL |
| 156 | VMSVATIVIVDICITGGLLLLVYYWS |
| 157 | MALIVLGGVAGLLLFIGLGIFF |

In particular embodiments, a CAR comprises an antibody or antigen binding fragment thereof comprising an amino acid sequence set forth in Table 1; a spacer domain; a transmembrane domain comprising an amino acid sequence set forth in any one of SEQ ID NOs: 151, 152, 153, 154, 155, 156, and 157; one or more costimulatory signaling domains; and a primary signaling domain.

4. Intracellular Signaling Domain

Chimeric antigen receptors contemplated herein comprise on or more intracellular signaling domains that function to transduce a signal of extracellular antigen recognition to the interior of the immune effector cell and elicit one or more effector cell functions including but not limited to activation, cytokine production, proliferation and cytotoxic activity. T cell activation is mediated by two distinct classes of intracellular signaling domains: primary signaling domains that initiate antigen-dependent primary activation through the TCR (e.g., a TCR/CD3 complex) and costimulatory signaling domains that act in an antigen-independent manner to provide a secondary or costimulatory signal. The intracellular primary signaling and costimulatory signaling domains may be linked in any order in tandem to the carboxyl terminus of the transmembrane domain.

In particular embodiments a CAR comprises one or more intracellular signaling domains that comprise one or more costimulatory signaling domains and a primary signaling domain.

A primary signaling domain regulates primary activation of the TCR complex either in a stimulatory way, or in an inhibitory way. Primary signaling domains that act in a stimulatory manner may contain signaling motifs which are known as immunoreceptor tyrosine-based activation motifs or ITAMs. Primary signaling domains comprising one or more ITAMs may be obtained, isolated, or derived from FcRγ, FcRβ, CD3γ, CD3δ, CD3δ, CD3ζ, CD22, CD79a, CD79b, and CD66d. In particular embodiments, a CAR comprises an antibody or antigen binding fragment thereof comprising an amino acid sequence set forth in Table 1; a spacer domain; a transmembrane domain; a primary signaling domain isolated from a polypeptide selected from the group consisting of FcRγ, FcRβ, CD3γ, CD3δ, CD3ε, CD3ζ, CD22, CD79a, CD79b, and CD66d; and optionally, one or more co-stimulatory signaling domains.

A costimulatory signaling domain provides a second signal required for efficient activation and function of immune effector cells upon binding to antigen. Costimulatory signaling domains may be obtained, isolated, or derived from costimulatory molecules selected from the group consisting of: TLR1, TLR2, TLR3, TLR4, TLR5, TLR6, TLR7, TLR8, TLR9, TLR10, CARD11, CD2, CD7, CD27, CD28, CD30, CD40, ICAM, CD83, CD94, CD134 (OX40), CD137 (4-1BB), CD278 (ICOS), DAP10, LAT, SLP76, TRAT1, TNFR2, TNFRS14, TNFRS18, TNFRS25, and ZAP70.

In particular embodiments, a CAR comprises an antibody or antigen binding fragment thereof comprising an amino acid sequence set forth in Table 1; a spacer domain; a transmembrane domain; a primary signaling domain isolated from a polypeptide selected from the group consisting of FcRγ, FcRβ, CD3γ, CD3δ, CD3ε, CD3ζ, CD22, CD79a, CD79b, and CD66d; and optionally, one or more costimulatory signaling domains isolated from a costimulatory molecule selected from the group consisting of: TLR1, TLR2, TLR3, TLR4, TLR5, TLR6, TLR7, TLR8, TLR9, TLR10, CARD11, CD2, CD7, CD27, CD28, CD30, CD40, ICAM, CD83, CD94, CD134 (OX40), CD137 (4-1BB), CD278 (ICOS), DAP10, LAT, SLP76, TRAT1, TNFR2, TNFRS14, TNFRS18, TNFRS25, and ZAP70.

In particular embodiments, a CAR comprises an antibody or antigen binding fragment thereof comprising an amino acid sequence set forth in Table 1; a spacer domain; a transmembrane domain; a primary signaling domain and one or more costimulatory signaling domains comprising an amino acid sequence set forth in Table 4.

TABLE 4

| SEQ ID NO: | DOMAIN | AMINO ACID SEQUENCE |
|---|---|---|
| 158 | PRIMARY | RVKFSRSADAPAYQQGQNQLYNELNLGRREEYDVLDKRRGRDPEMGGKP RRKNPQEGLYNELQKDKMAEAYSEIGMKGERRRGKGHDGLYQGLSTATK DTYDALHMQALPPR |
| 159 | COSTIM | KRGRKKLLYIFKQPFMRPVQTTQEEDGCSCRFPEEEEGGCEL |
| 160 | COSTIM | RSKRSRLLHSDYMNMTPRRPGPTRKHYQPYAPPRDFAAYRS |
| 161 | COSTIM | ALYLLRRDQRLPPDAHKPPGGGSFRTPIQEEQADAHSTLAKI |
| 162 | COSTIM | TKKKYSSSVHDPNGEYMFMRAVNTAKKSRLTDVTL |
| 163 | COSTIM | QRRKYRSNKGESPVEPAEPCHYSCPREEEGSTIPIQEDYRKPEPACSP |
| 164 | COSTIM | KKKPLCLQREAKVPHLPADKARGTQGPEQQHLLITAPSSSSSSLESSAS ALDRRAPTRNQPQAPGVEASGAGEARASTGSSDSSPGGHGTQVNVTCIV NVCSSSDHSSQCSSQASSTMGDTDSSPSESPKDEQVPFSKEECAFRSQL ETPETLLGSTEEKPLPLGVPDAGMKPS |

In particular embodiments, a CAR comprises an antibody or antigen binding fragment thereof comprising an amino acid sequence set forth in Table 1; a spacer domain; a transmembrane domain; one or more costimulatory domains comprising an amino acid sequence set forth in any one of SEQ ID NOs: 159, 160, 161, 162, 163, and 164 or an amino acid sequence at least 95% identical thereto; and a primary signaling domain comprising an amino acid sequence set forth in SEQ ID NO: 158 or an amino acid sequence at least 95% identical thereto.

E. Illustrative Chimeric Antigen Receptors

In particular embodiments, a CAR comprises an antibody or antigen binding fragment thereof comprising an amino acid sequence set forth in Table 1; a spacer domain comprising a hinge domain or fragment thereof selected from the group consisting of a CD4 hinge, a CD8β hinge, a CD8α hinge, a CD28 hinge, a CD134 hinge, a CD137 hinge, a CD152 hinge, a CD278 hinge, an IgG1 hinge, an IgG2 hinge, an IgG3 hinge, and an IgG4 hinge; a transmembrane domain isolated or derived from a polypeptide selected from the group consisting of an alpha, beta, gamma, or delta chain of the T-cell receptor, CD3δ, CD3ε, CD3γ, CD3ζ, CD4, CD5, CD8α, CD9, CD16, CD22, CD27, CD28, CD33, CD37, CD45, CD64, CD80, CD86, CD134, CD137, CD152, CD154, CD278, AMN, and PDCD1; one or more costimulatory signaling domains isolated from a costimulatory molecule selected from the group consisting of: TLR1, TLR2, TLR3, TLR4, TLR5, TLR6, TLR7, TLR8, TLR9, TLR10, CARD11, CD2, CD7, CD27, CD28, CD30, CD40, ICAM, CD83, CD94, CD134 (OX40), CD137 (4-1BB), CD278 (ICOS), DAP10, LAT, SLP76, TRAT1, TNFR2, TNFRS14, TNFRS18, TNFRS25, and ZAP70; and a primary signaling domain isolated from CD3ζ, CD22, CD79a, CD79b, or CD66d.

In particular embodiments, a CAR comprises an antibody or antigen binding fragment thereof comprising an amino acid sequence set forth in Table 1; a spacer domain comprising a hinge domain or fragment thereof selected from the group consisting of a CD8α hinge, a CD28 hinge, an IgG1 hinge, and an IgG4 hinge; a CD8α or CD28 transmembrane domain; a CD134, CD137, or CD278 costimulatory domain; and a CD3ζ primary signaling domain.

In particular embodiments, a CAR comprises an antibody or antigen binding fragment thereof comprising an amino acid sequence set forth in SEQ ID NO: 19 or SEQ ID NO: 20; a spacer domain comprising an amino acid sequence set forth in SEQ ID NO: 145, SEQ ID NO: 146, SEQ ID NO: 148, or SEQ ID NO: 150; a transmembrane domain comprising an amino acid sequence set forth in SEQ ID NO: 151 or SEQ ID NO: 153; a costimulatory domain comprising an amino acid sequence set forth in SEQ ID NO: 159, SEQ ID NO: 160, or SEQ ID NO: 162; and a primary signaling domain comprising an amino acid sequence set forth in SEQ ID NO: 158. In particular embodiments, a CAR comprises an amino acid sequence set forth in any one of SEQ ID NOs: 165, 166, 167, 168, 169, 170, 171, 172, 173, 174, 175, 176, 177, 178, 179, 180, 181, 182, 183, 184, 185, 186, 187, and 188. In particular embodiments, a CAR comprises an amino acid sequence set forth in any one of SEQ ID NOs: 189, 190, 191, 192, 193, 194, 195, 196, 197, 198, 199, 200, 201, 202, 203, 204, 205, 206, 207, 208, 209, 210, 211, and 212.

| SEQ ID NO. | AMINO ACID SEQUENCE |
|---|---|
| 165 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCARDEYGGFDIWGQGTMVTVSSGGGGSGGGGSGG<br>GGSGGGGSEIVLTQSPATLSLSPGERATLSCRASQSVSSYLAWYQQKPGQAPRLLIYDASNRATG<br>IPARFSGSGSGTDFTLTISSLEPEDFAVYYCQQRVVYPITFGGGTKVEIKTTTPAPRPPTPAPTI<br>ASQPLSLRPEACRPAAGGAVHTRGLDFACDIYIWAPLAGTCGVLLLSLVITLYCKRGRKKLLYIF<br>KQPFMRPVQTTQEEDGCSCRFPEEEEGGCELRVKFSRSADAPAYQQGQNQLYNELNLGRREEYDV<br>LDKRRGRDPEMGGKPRRKNPQEGLYNELQKDKMAEAYSEIGMKGERRRGKGHDGLYQGLSTATKD<br>TYDALHMQALPPR |
| 166 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCARDEYGGFDIWGQGTMVTVSSGGGGSGGGGSGG<br>GGSGGGGSEIVLTQSPATLSLSPGERATLSCRASQSVSSYLAWYQQKPGQAPRLLIYDASNRATG<br>IPARFSGSGSGTDFTLTISSLEPEDFAVYYCQQRVVYPITFGGGTKVEIKTTTPAPRPPTPAPTI<br>ASQPLSLRPEACRPAAGGAVHTRGLDFACDIYIWAPLAGTCGVLLLSLVITLYCRSKRSRLLHSD<br>YMNMTPRRPGPTRKHYQPYAPPRDFAAYRSRVKFSRSADAPAYQQGQNQLYNELNLGRREEYDVL<br>DKRRGRDPEMGGKPRRKNPQEGLYNELQKDKMAEAYSEIGMKGERRRGKGHDGLYQGLSTATKDT<br>YDALHMQALPPR |
| 167 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCARDEYGGFDIWGQGTMVTVSSGGGGSGGGGSGG<br>GGSGGGGSEIVLTQSPATLSLSPGERATLSCRASQSVSSYLAWYQQKPGQAPRLLIYDASNRATG<br>IPARFSGSGSGTDFTLTISSLEPEDFAVYYCQQRVVYPITFGGGTKVEIKTTTPAPRPPTPAPTI<br>ASQPLSLRPEACRPAAGGAVHTRGLDFACDIYIWAPLAGTCGVLLLSLVITLYCTKKKYSSSVHD<br>PNGEYMFMRAVNTAKKSRLTDVTLRVKFSRSADAPAYQQGQNQLYNELNLGRREEYDVLDKRRGR<br>DPEMGGKPRRKNPQEGLYNELQKDKMAEAYSEIGMKGERRRGKGHDGLYQGLSTATKDTYDALHM<br>QALPPR |
| 168 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCARDEYGGFDIWGQGTMVTVSSGGGGSGGGGSGG<br>GGSGGGGSEIVLTQSPATLSLSPGERATLSCRASQSVSSYLAWYQQKPGQAPRLLIYDASNRATG<br>IPARFSGSGSGTDFTLTISSLEPEDFAVYYCQQRVVYPITFGGGTKVEIKTTTPAPRPPTPAPTI<br>ASQPLSLRPEACRPAAGGAVHTRGLDFACDFWVLVVVGGVLACYSLLVTVAFIIFWVKRGRKKLL<br>YIFKQPFMRPVQTTQEEDGCSCRFPEEEEGGCELRVKFSRSADAPAYQQGQNQLYNELNLGRREE<br>YDVLDKRRGRDPEMGGKPRRKNPQEGLYNELQKDKMAEAYSEIGMKGERRRGKGHDGLYQGLSTA<br>TKDTYDALHMQALPPR |
| 169 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCARDEYGGFDIWGQGTMVTVSSGGGGSGGGGSGG<br>GGSGGGGSEIVLTQSPATLSLSPGERATLSCRASQSVSSYLAWYQQKPGQAPRLLIYDASNRATG |

-continued

| SEQ ID NO. | AMINO ACID SEQUENCE |
|---|---|
| | IPARFSGSGSGTDFTLTISSLEPEDFAVYYCQQRVVYPITFGGGTKVEIKTTTPAPRPPTPAPTI<br>ASQPLSLRPEACRPAAGGAVHTRGLDFACDFWVLVVVGGVLACYSLLVTVAFIIFWVRSKRSRLL<br>HSDYMNMTPRRPGPTRKHYQPYAPPRDFAAYRSRVKFSRSADAPAYQQGQNQLYNELNLGRREEY<br>DVLDKRRGRDPEMGGKPRRKNPQEGLYNELQKDKMAEAYSEIGMKGERRRGKGHDGLYQGLSTAT<br>KDTYDALHMQALPPR |
| 170 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCARDEYGGFDIWGQGTMVTVSSGGGGSGGGGSGG<br>GGSGGGGSEIVLTQSPATLSLSPGERATLSCRASQSVSSYLAWYQQKPGQAPRLLIYDASNRATG<br>IPARFSGSGSGTDFTLTISSLEPEDFAVYYCQQRVVYPITFGGGTKVEIKTTTPAPRPPTPAPTI<br>ASQPLSLRPEACRPAAGGAVHTRGLDFACDFWVLVVVGGVLACYSLLVTVAFIIFWVTKKKYSSS<br>VHDPNGEYMEMRAVNTAKKSRLTDVTLRVKFSRSADAPAYQQGQNQLYNELNLGRREEYDVLDKR<br>RGRDPEMGGKPRRKNPQEGLYNELQKDKMAEAYSEIGMKGERRRGKGHDGLYQGLSTATKDTYDA<br>LHMQALPPR |
| 171 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCARDEYGGFDIWGQGTMVTVSSGGGGSGGGGSGG<br>GGSGGGGSEIVLTQSPATLSLSPGERATLSCRASQSVSSYLAWYQQKPGQAPRLLIYDASNRATG<br>IPARFSGSGSGTDFTLTISSLEPEDFAVYYCQQRVVYPITFGGGTKVEIKIEVMYPPPYLDNEKS<br>NGTIIHVKGKHLCPSPLFPGPSKPIYIWAPLAGTCGVLLLSLVITLYCKRGRKKLLYIFKQPFMR<br>PVQTTQEEDGCSCRFPEEEEGGCELRVKFSRSADAPAYQQGQNQLYNELNLGRREEYDVLDKRRG<br>RDPEMGGKPRRKNPQEGLYNELQKDKMAEAYSEIGMKGERRRGKGHDGLYQGLSTATKDTYDALH<br>MQALPPR |
| 172 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCARDEYGGFDIWGQGTMVTVSSGGGGSGGGGSGG<br>GGSGGGGSEIVLTQSPATLSLSPGERATLSCRASQSVSSYLAWYQQKPGQAPRLLIYDASNRATG<br>IPARFSGSGSGTDFTLTISSLEPEDFAVYYCQQRVVYPITFGGGTKVEIKIEVMYPPPYLDNEKS<br>NGTIIHVKGKHLCPSPLFPGPSKPIYIWAPLAGTCGVLLLSLVITLYCRSKRSRLLHSDYMNMTP<br>RRPGPTRKHYQPYAPPRDFAAYRSRVKFSRSADAPAYQQGQNQLYNELNLGRREEYDVLDKRRGR<br>DPEMGGKPRRKNPQEGLYNELQKDKMAEAYSEIGMKGERRRGKGHDGLYQGLSTATKDTYDALHM<br>QALPPR |
| 173 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCARDEYGGFDIWGQGTMVTVSSGGGGSGGGGSGG<br>GGSGGGGSEIVLTQSPATLSLSPGERATLSCRASQSVSSYLAWYQQKPGQAPRLLIYDASNRATG<br>IPARFSGSGSGTDFTLTISSLEPEDFAVYYCQQRVVYPITFGGGTKVEIKIEVMYPPPYLDNEKS<br>NGTIIHVKGKHLCPSPLFPGPSKPIYIWAPLAGTCGVLLLSLVITLYCTKKKYSSSVHDPNGEYM<br>FMRAVNTAKKSRLTDVTLRVKFSRSADAPAYQQGQNQLYNELNLGRREEYDVLDKRRGRDPEMGG<br>KPRRKNPQEGLYNELQKDKMAEAYSEIGMKGERRRGKGHDGLYQGLSTATKDTYDALHMQALPPR |
| 174 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCARDEYGGFDIWGQGTMVTVSSGGGGSGGGGSGG<br>GGSGGGGSEIVLTQSPATLSLSPGERATLSCRASQSVSSYLAWYQQKPGQAPRLLIYDASNRATG<br>IPARFSGSGSGTDFTLTISSLEPEDFAVYYCQQRVVYPITFGGGTKVEIKIEVMYPPPYLDNEKS<br>NGTIIHVKGKHLCPSPLFPGPSKPFWVLVVVGGVLACYSLLVTVAFIIFWVKRGRKKLLYIFKQP<br>FMRPVQTTQEEDGCSCRFPEEEEGGCELRVKFSRSADAPAYQQGQNQLYNELNLGRREEYDVLDK<br>RRGRDPEMGGKPRRKNPQEGLYNELQKDKMAEAYSEIGMKGERRRGKGHDGLYQGLSTATKDTYD<br>ALHMQALPPR |
| 175 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCARDEYGGFDIWGQGTMVTVSSGGGGSGGGGSGG<br>GGSGGGGSEIVLTQSPATLSLSPGERATLSCRASQSVSSYLAWYQQKPGQAPRLLIYDASNRATG<br>IPARFSGSGSGTDFTLTISSLEPEDFAVYYCQQRVVYPITFGGGTKVEIKIEVMYPPPYLDNEKS<br>NGTIIHVKGKHLCPSPLFPGPSKPFWVLVVVGGVLACYSLLVTVAFIIFWVRSKRSRLLHSDYMN<br>MTPRRPGPTRKHYQPYAPPRDFAAYRSRVKFSRSADAPAYQQGQNQLYNELNLGRREEYDVLDKR<br>RGRDPEMGGKPRRKNPQEGLYNELQKDKMAEAYSEIGMKGERRRGKGHDGLYQGLSTATKDTYDA<br>LHMQALPPR |
| 176 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCARDEYGGFDIWGQGTMVTVSSGGGGSGGGGSGG<br>GGSGGGGSEIVLTQSPATLSLSPGERATLSCRASQSVSSYLAWYQQKPGQAPRLLIYDASNRATG<br>IPARFSGSGSGTDFTLTISSLEPEDFAVYYCQQRVVYPITFGGGTKVEIKIEVMYPPPYLDNEKS<br>NGTIIHVKGKHLCPSPLFPGPSKPFWVLVVVGGVLACYSLLVTVAFIIFWVTKKKYSSSVHDPNG<br>EYMEMRAVNTAKKSRLTDVTLRVKFSRSADAPAYQQGQNQLYNELNLGRREEYDVLDKRRGRDPE<br>MGGKPRRKNPQEGLYNELQKDKMAEAYSEIGMKGERRRGKGHDGLYQGLSTATKDTYDALHMQAL<br>PPR |
| 177 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCARDEYGGFDIWGQGTMVTVSSGGGGSGGGGSGG<br>GGSGGGGSEIVLTQSPATLSLSPGERATLSCRASQSVSSYLAWYQQKPGQAPRLLIYDASNRATG<br>IPARFSGSGSGTDFTLTISSLEPEDFAVYYCQQRVVYPITFGGGTKVEIKESKYGPPCPPCPIYI<br>WAPLAGTCGVLLLSLVITLYCKRGRKKLLYIFKQPEMRPVQTTQEEDGCSCRFPEEEEGGCELRV<br>KFSRSADAPAYQQGQNQLYNELNLGRREEYDVLDKRRGRDPEMGGKPRRKNPQEGLYNELQKDKM<br>AEAYSEIGMKGERRRGKGHDGLYQGLSTATKDTYDALHMQALPPR |

-continued

| SEQ ID NO. | AMINO ACID SEQUENCE |
|---|---|
| 178 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCARDEYGGFDIWGQGTMVTVSSGGGGSGGGGSGG<br>GGSGGGGSEIVLTQSPATLSLSPGERATLSCRASQSVSSYLAWYQQKPGQAPRLLIYDASNRATG<br>IPARFSGSGSGTDFTLTISSLEPEDFAVYYCQQRVVYPITFGGGTKVEIKESKYGPPCPPCPIYI<br>WAPLAGTCGVLLLSLVITLYCRSKRSRLLHSDYMNMTPRRPGPTRKHYQPYAPPRDFAAYRSRVK<br>FSRSADAPAYQQGQNQLYNELNLGRREEYDVLDKRRGRDPEMGGKPRRKNPQEGLYNELQKDKMA<br>EAYSEIGMKGERRRGKGHDGLYQGLSTATKDTYDALHMQALPPR |
| 179 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCARDEYGGFDIWGQGTMVTVSSGGGGSGGGGSGG<br>GGSGGGGSEIVLTQSPATLSLSPGERATLSCRASQSVSSYLAWYQQKPGQAPRLLIYDASNRATG<br>IPARFSGSGSGTDFTLTISSLEPEDFAVYYCQQRVVYPITFGGGTKVEIKESKYGPPCPPCPIYI<br>WAPLAGTCGVLLLSLVITLYCTKKKYSSSVHDPNGEYMEMRAVNTAKKSRLTDVTLRVKFSRSAD<br>APAYQQGQNQLYNELNLGRREEYDVLDKRRGRDPEMGGKPRRKNPQEGLYNELQKDKMAEAYSEI<br>GMKGERRRGKGHDGLYQGLSTATKDTYDALHMQALPPR |
| 180 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCARDEYGGFDIWGQGTMVTVSSGGGGSGGGGSGG<br>GGSGGGGSEIVLTQSPATLSLSPGERATLSCRASQSVSSYLAWYQQKPGQAPRLLIYDASNRATG<br>IPARFSGSGSGTDFTLTISSLEPEDFAVYYCQQRVVYPITFGGGTKVEIKESKYGPPCPPCPFWV<br>LVVVGGVLACYSLLVTVAFIIFWVKRGRKKLLYIFKQPEMRPVQTTQEEDGCSCRFPEEEEGGCE<br>LRVKFSRSADAPAYQQGQNQLYNELNLGRREEYDVLDKRRGRDPEMGGKPRRKNPQEGLYNELQK<br>DKMAEAYSEIGMKGERRRGKGHDGLYQGLSTATKDTYDALHMQALPPR |
| 181 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCARDEYGGFDIWGQGTMVTVSSGGGGSGGGGSGG<br>GGSGGGGSEIVLTQSPATLSLSPGERATLSCRASQSVSSYLAWYQQKPGQAPRLLIYDASNRATG<br>IPARFSGSGSGTDFTLTISSLEPEDFAVYYCQQRVVYPITFGGGTKVEIKESKYGPPCPPCPFWV<br>LVVVGGVLACYSLLVTVAFIIFWVRSKRSRLLHSDYMNMTPRRPGPTRKHYQPYAPPRDFAAYRS<br>RVKFSRSADAPAYQQGQNQLYNELNLGRREEYDVLDKRRGRDPEMGGKPRRKNPQEGLYNELQKD<br>KMAEAYSEIGMKGERRRGKGHDGLYQGLSTATKDTYDALHMQALPPR |
| 182 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCARDEYGGFDIWGQGTMVTVSSGGGGSGGGGSGG<br>GGSGGGGSEIVLTQSPATLSLSPGERATLSCRASQSVSSYLAWYQQKPGQAPRLLIYDASNRATG<br>IPARFSGSGSGTDFTLTISSLEPEDFAVYYCQQRVVYPITFGGGTKVEIKESKYGPPCPPCPFWV<br>LVVVGGVLACYSLLVTVAFIIFWVTKKKYSSSVHDPNGEYMFMRAVNTAKKSRLTDVTLRVKFSR<br>SADAPAYQQGQNQLYNELNLGRREEYDVLDKRRGRDPEMGGKPRRKNPQEGLYNELQKDKMAEAY<br>SEIGMKGERRRGKGHDGLYQGLSTATKDTYDALHMQALPPR |
| 183 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCARDEYGGFDIWGQGTMVTVSSGGGGSGGGGSGG<br>GGSGGGGSEIVLTQSPATLSLSPGERATLSCRASQSVSSYLAWYQQKPGQAPRLLIYDASNRATG<br>IPARFSGSGSGTDFTLTISSLEPEDFAVYYCQQRVVYPITFGGGTKVEIKLEPKSCDKTHTCPPC<br>PIYIWAPLAGTCGVLLLSLVITLYCKRGRKKLLYIFKQPFMRPVQTTQEEDGCSCRFPEEEEGGC<br>ELRVKFSRSADAPAYQQGQNQLYNELNLGRREEYDVLDKRRGRDPEMGGKPRRKNPQEGLYNELQ<br>KDKMAEAYSEIGMKGERRRGKGHDGLYQGLSTATKDTYDALHMQALPPR |
| 184 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCARDEYGGFDIWGQGTMVTVSSGGGGSGGGGSGG<br>GGSGGGGSEIVLTQSPATLSLSPGERATLSCRASQSVSSYLAWYQQKPGQAPRLLIYDASNRATG<br>IPARFSGSGSGTDFTLTISSLEPEDFAVYYCQQRVVYPITFGGGTKVEIKLEPKSCDKTHTCPPC<br>PIYIWAPLAGTCGVLLLSLVITLYCRSKRSRLLHSDYMNMTPRRPGPTRKHYQPYAPPRDFAAYR<br>SRVKFSRSADAPAYQQGQNQLYNELNLGRREEYDVLDKRRGRDPEMGGKPRRKNPQEGLYNELQK<br>DKMAEAYSEIGMKGERRRGKGHDGLYQGLSTATKDTYDALHMQALPPR |
| 185 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCARDEYGGFDIWGQGTMVTVSSGGGGSGGGGSGG<br>GGSGGGGSEIVLTQSPATLSLSPGERATLSCRASQSVSSYLAWYQQKPGQAPRLLIYDASNRATG<br>IPARFSGSGSGTDFTLTISSLEPEDFAVYYCQQRVVYPITFGGGTKVEIKLEPKSCDKTHTCPPC<br>PIYIWAPLAGTCGVLLLSLVITLYCTKKKYSSSVHDPNGEYMEMRAVNTAKKSRLTDVTLRVKFS<br>RSADAPAYQQGQNQLYNELNLGRREEYDVLDKRRGRDPEMGGKPRRKNPQEGLYNELQKDKMAEA<br>YSEIGMKGERRRGKGHDGLYQGLSTATKDTYDALHMQALPPR |
| 186 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCARDEYGGFDIWGQGTMVTVSSGGGGSGGGGSGG<br>GGSGGGGSEIVLTQSPATLSLSPGERATLSCRASQSVSSYLAWYQQKPGQAPRLLIYDASNRATG<br>IPARFSGSGSGTDFTLTISSLEPEDFAVYYCQQRVVYPITFGGGTKVEIKLEPKSCDKTHTCPPC<br>PFWVLVVVGGVLACYSLLVTVAFIIFWVKRGRKKLLYIFKQPFMRPVQTTQEEDGCSCRFPEEEE<br>GGCELRVKFSRSADAPAYQQGQNQLYNELNLGRREEYDVLDKRRGRDPEMGGKPRRKNPQEGLYN<br>ELQKDKMAEAYSEIGMKGERRRGKGHDGLYQGLSTATKDTYDALHMQALPPR |
| 187 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCARDEYGGFDIWGQGTMVTVSSGGGGSGGGGSGG<br>GGSGGGGSEIVLTQSPATLSLSPGERATLSCRASQSVSSYLAWYQQKPGQAPRLLIYDASNRATG<br>IPARFSGSGSGTDFTLTISSLEPEDFAVYYCQQRVVYPITFGGGTKVEIKLEPKSCDKTHTCPPC |

-continued

| SEQ ID NO. | AMINO ACID SEQUENCE |
|---|---|
| | PFWVLVVVGGVLACYSLLVTVAFIIFWVRSKRSRLLHSDYMNMTPRRPGPTRKHYQPYAPPRDFA AYRSRVKFSRSADAPAYQQGQNQLYNELNLGRREEYDVLDKRRGRDPEMGGKPRRKNPQEGLYNE LQKDKMAEAYSEIGMKGERRRGKGHDGLYQGLSTATKDTYDALHMQALPPR |
| 188 | QITLKESGPTLVKPTQTLTLTCTFSGFSLSTSGVGVGWIRQPPGKALEWLALIYWNDEKRYSPSL KSRLTITKDTSKNQVVLTMTNMDPVDTAVYYCARDEYGGFDIWGQGTMVTVSSGGGGSGGGGSGG GGSGGGGSEIVLTQSPATLSLSPGERATLSCRASQSVSSYLAWYQQKPGQAPRLLIYDASNRATG IPARFSGSGSGTDFTLTISSLEPEDFAVYYCQQRVVYPITFGGGTKVEIKLEPKSCDKTHTCPPC PFWVLVVVGGVLACYSLLVTVAFIIFWVTKKKYSSSVHDPNGEYMFMRAVNTAKKSRLTDVTLRV KFSRSADAPAYQQGQNQLYNELNLGRREEYDVLDKRRGRDPEMGGKPRRKNPQEGLYNELQKDKM AEAYSEIGMKGERRRGKGHDGLYQGLSTATKDTYDALHMQALPPR |
| 189 | EIVLTQSPATLSLSPGERATLSCRASQSVSSYLAWYQQKPGQAPRLLIYDASNRATGIPARFSGS GSGTDFTLTISSLEPEDFAVYYCQQRVVYPITFGGGTKVEIKGGGGSGGGGSGGGGSGGGGSQIT LKESGPTLVKPTQTLTLTCTFSGFSLSTSGVGVGWIRQPPGKALEWLALIYWNDEKRYSPSLKSR LTITKDTSKNQVVLTMTNMDPVDTAVYYCARDEYGGFDIWGQGTMVTVSSTTTPAPRPPTPAPTI ASQPLSLRPEACRPAAGGAVHTRGLDFACDIYIWAPLAGTCGVLLLSLVITLYCKRGRKKLLYIF KQPFMRPVQTTQEEDGCSCRFPEEEEGGCELRVKESRSADAPAYQQGQNQLYNELNLGRREEYDV LDKRRGRDPEMGGKPRRKNPQEGLYNELQKDKMAEAYSEIGMKGERRRGKGHDGLYQGLSTATKD TYDALHMQALPPR |
| 190 | EIVLTQSPATLSLSPGERATLSCRASQSVSSYLAWYQQKPGQAPRLLIYDASNRATGIPARFSGS GSGTDFTLTISSLEPEDFAVYYCQQRVVYPITFGGGTKVEIKGGGGSGGGGSGGGGSGGGGSQIT LKESGPTLVKPTQTLTLTCTFSGFSLSTSGVGVGWIRQPPGKALEWLALIYWNDEKRYSPSLKSR LTITKDTSKNQVVLTMTNMDPVDTAVYYCARDEYGGFDIWGQGTMVTVSSTTTPAPRPPTPAPTI ASQPLSLRPEACRPAAGGAVHTRGLDFACDIYIWAPLAGTCGVLLLSLVITLYCRSKRSRLLHSD YMNMTPRRPGPTRKHYQPYAPPRDFAAYRSRVKFSRSADAPAYQQGQNQLYNELNLGRREEYDVL DKRRGRDPEMGGKPRRKNPQEGLYNELQKDKMAEAYSEIGMKGERRRGKGHDGLYQGLSTATKDT YDALHMQALPPR |
| 191 | EIVLTQSPATLSLSPGERATLSCRASQSVSSYLAWYQQKPGQAPRLLIYDASNRATGIPARFSGS GSGTDFTLTISSLEPEDFAVYYCQQRVVYPITFGGGTKVEIKGGGGSGGGGSGGGGSGGGGSQIT LKESGPTLVKPTQTLTLTCTFSGFSLSTSGVGVGWIRQPPGKALEWLALIYWNDEKRYSPSLKSR LTITKDTSKNQVVLTMTNMDPVDTAVYYCARDEYGGFDIWGQGTMVTVSSTTTPAPRPPTPAPTI ASQPLSLRPEACRPAAGGAVHTRGLDFACDIYIWAPLAGTCGVLLLSLVITLYCTKKKYSSSVHD PNGEYMFMRAVNTAKKSRLTDVTLRVKFSRSADAPAYQQGQNQLYNELNLGRREEYDVLDKRRGR DPEMGGKPRRKNPQEGLYNELQKDKMAEAYSEIGMKGERRRGKGHDGLYQGLSTATKDTYDALHM QALPPR |
| 192 | EIVLTQSPATLSLSPGERATLSCRASQSVSSYLAWYQQKPGQAPRLLIYDASNRATGIPARFSGS GSGTDFTLTISSLEPEDFAVYYCQQRVVYPITFGGGTKVEIKGGGGSGGGGSGGGGSGGGGSQIT LKESGPTLVKPTQTLTLTCTFSGFSLSTSGVGVGWIRQPPGKALEWLALIYWNDEKRYSPSLKSR LTITKDTSKNQVVLTMTNMDPVDTAVYYCARDEYGGFDIWGQGTMVTVSSTTTPAPRPPTPAPTI ASQPLSLRPEACRPAAGGAVHTRGLDFACDFWVLVVVGGVLACYSLLVTVAFIIFWVKRGRKKLL YIFKQPFMRPVQTTQEEDGCSCRFPEEEEGGCELRVKFSRSADAPAYQQGQNQLYNELNLGRREE YDVLDKRRGRDPEMGGKPRRKNPQEGLYNELQKDKMAEAYSEIGMKGERRRGKGHDGLYQGLSTA TKDTYDALHMQALPPR |
| 193 | EIVLTQSPATLSLSPGERATLSCRASQSVSSYLAWYQQKPGQAPRLLIYDASNRATGIPARFSGS GSGTDFTLTISSLEPEDFAVYYCQQRVVYPITFGGGTKVEIKGGGGSGGGGSGGGGSGGGGSQIT LKESGPTLVKPTQTLTLTCTFSGFSLSTSGVGVGWIRQPPGKALEWLALIYWNDEKRYSPSLKSR LTITKDTSKNQVVLTMTNMDPVDTAVYYCARDEYGGFDIWGQGTMVTVSSTTTPAPRPPTPAPTI ASQPLSLRPEACRPAAGGAVHTRGLDFACDFWVLVVVGGVLACYSLLVTVAFIIFWVRSKRSRLL HSDYMNMTPRRPGPTRKHYQPYAPPRDFAAYRSRVKFSRSADAPAYQQGQNQLYNELNLGRREEY DVLDKRRGRDPEMGGKPRRKNPQEGLYNELQKDKMAEAYSEIGMKGERRRGKGHDGLYQGLSTAT KDTYDALHMQALPPR |
| 194 | EIVLTQSPATLSLSPGERATLSCRASQSVSSYLAWYQQKPGQAPRLLIYDASNRATGIPARFSGS GSGTDFTLTISSLEPEDFAVYYCQQRVVYPITFGGGTKVEIKGGGGSGGGGSGGGGSGGGGSQIT LKESGPTLVKPTQTLTLTCTFSGFSLSTSGVGVGWIRQPPGKALEWLALIYWNDEKRYSPSLKSR LTITKDTSKNQVVLTMTNMDPVDTAVYYCARDEYGGFDIWGQGTMVTVSSTTTPAPRPPTPAPTI ASQPLSLRPEACRPAAGGAVHTRGLDFACDFWVLVVVGGVLACYSLLVTVAFIIFWVTKKKYSSS VHDPNGEYMEMRAVNTAKKSRLTDVTLRVKFSRSADAPAYQQGQNQLYNELNLGRREEYDVLDKR RGRDPEMGGKPRRKNPQEGLYNELQKDKMAEAYSEIGMKGERRRGKGHDGLYQGLSTATKDTYDA LHMQALPPR |
| 195 | EIVLTQSPATLSLSPGERATLSCRASQSVSSYLAWYQQKPGQAPRLLIYDASNRATGIPARFSGS GSGTDFTLTISSLEPEDFAVYYCQQRVVYPITFGGGTKVEIKGGGGSGGGGSGGGGSGGGGSQIT LKESGPTLVKPTQTLTLTCTFSGFSLSTSGVGVGWIRQPPGKALEWLALIYWNDEKRYSPSLKSR LTITKDTSKNQVVLTMTNMDPVDTAVYYCARDEYGGFDIWGQGTMVTVSSIEVMYPPPYLDNEKS NGTIIHVKGKHLCPSPLFPGPSKPIYIWAPLAGTCGVLLLSLVITLYCKRGRKKLLYIFKQPFMR PVQTTQEEDGCSCRFPEEEEGGCELRVKFSRSADAPAYQQGQNQLYNELNLGRREEYDVLDKRRG RDPEMGGKPRRKNPQEGLYNELQKDKMAEAYSEIGMKGERRRGKGHDGLYQGLSTATKDTYDALH MQALPPR |

-continued

| SEQ ID NO. | AMINO ACID SEQUENCE |
|---|---|
| 196 | EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 197 | EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 198 | EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 199 | EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 200 | EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 201 | EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 202 | EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 203 | EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 204 | EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |

-continued

| SEQ ID NO. | AMINO ACID SEQUENCE |
|---|---|
| 205 | EIVLTQSPATLSLSPGERATLSCRASQSVSSYLAWYQQKPGQAPRLLIYDASNRATGIPARFSGS<br>GSGTDFTLTISSLEPEDFAVYYCQQRVVYPITFGGGTKVEIKGGGGSGGGGSGGGGSGGGGSQIT<br>LKESGPTLVKPTQTLTLTCTFSGFSLSTSGVGVGWIRQPPGKALEWLALIYWNDEKRYSPSLKSR<br>LTITKDTSKNQVVLTMTNMDPVDTAVYYCARDEYGGFDIWGQGTMVTVSSESKYGPPCPPCPFWV<br>LVVVGGVLACYSLLVTVAFIIFWVRSKRSRLLHSDYMNMTPRRPGPTRKHYQPYAPPRDFAAYRS<br>RVKFSRSADAPAYQQGQNQLYNELNLGRREEYDVLDKRRGRDPEMGGKPRRKNPQEGLYNELQKD<br>KMAEAYSEIGMKGERRRGKGHDGLYQGLSTATKDTYDALHMQALPPR |
| 206 | EIVLTQSPATLSLSPGERATLSCRASQSVSSYLAWYQQKPGQAPRLLIYDASNRATGIPARFSGS<br>GSGTDFTLTISSLEPEDFAVYYCQQRVVYPITFGGGTKVEIKGGGGSGGGGSGGGGSGGGGSQIT<br>LKESGPTLVKPTQTLTLTCTFSGFSLSTSGVGVGWIRQPPGKALEWLALIYWNDEKRYSPSLKSR<br>LTITKDTSKNQVVLTMTNMDPVDTAVYYCARDEYGGFDIWGQGTMVTVSSESKYGPPCPPCPFWV<br>LVVVGGVLACYSLLVTVAFIIFWVTKKKYSSSVHDPNGEYMEMRAVNTAKKSRLTDVTLRVKFSR<br>SADAPAYQQGQNQLYNELNLGRREEYDVLDKRRGRDPEMGGKPRRKNPQEGLYNELQKDKMAEAY<br>SEIGMKGERRRGKGHDGLYQGLSTATKDTYDALHMQALPPR |
| 207 | EIVLTQSPATLSLSPGERATLSCRASQSVSSYLAWYQQKPGQAPRLLIYDASNRATGIPARFSGS<br>GSGTDFTLTISSLEPEDFAVYYCQQRVVYPITFGGGTKVEIKGGGGSGGGGSGGGGSGGGGSQIT<br>LKESGPTLVKPTQTLTLTCTFSGFSLSTSGVGVGWIRQPPGKALEWLALIYWNDEKRYSPSLKSR<br>LTITKDTSKNQVVLTMTNMDPVDTAVYYCARDEYGGFDIWGQGTMVTVSSLEPKSCDKTHTCPPC<br>PIYIWAPLAGTCGVLLLSLVITLYCKRGRKKLLYIFKQPFMRPVQTTQEEDGCSCRFPEEEEGGC<br>ELRVKFSRSADAPAYQQGQNQLYNELNLGRREEYDVLDKRRGRDPEMGGKPRRKNPQEGLYNELQ<br>KDKMAEAYSEIGMKGERRRGKGHDGLYQGLSTATKDTYDALHMQALPPR |
| 208 | EIVLTQSPATLSLSPGERATLSCRASQSVSSYLAWYQQKPGQAPRLLIYDASNRATGIPARFSGS<br>GSGTDFTLTISSLEPEDFAVYYCQQRVVYPITFGGGTKVEIKGGGGSGGGGSGGGGSGGGGSQIT<br>LKESGPTLVKPTQTLTLTCTFSGFSLSTSGVGVGWIRQPPGKALEWLALIYWNDEKRYSPSLKSR<br>LTITKDTSKNQVVLTMTNMDPVDTAVYYCARDEYGGFDIWGQGTMVTVSSLEPKSCDKTHTCPPC<br>PIYIWAPLAGTCGVLLLSLVITLYCRSKRSRLLHSDYMNMTPRRPGPTRKHYQPYAPPRDFAAYR<br>SRVKFSRSADAPAYQQGQNQLYNELNLGRREEYDVLDKRRGRDPEMGGKPRRKNPQEGLYNELQK<br>DKMAEAYSEIGMKGERRRGKGHDGLYQGLSTATKDTYDALHMQALPPR |
| 209 | EIVLTQSPATLSLSPGERATLSCRASQSVSSYLAWYQQKPGQAPRLLIYDASNRATGIPARFSGS<br>GSGTDFTLTISSLEPEDFAVYYCQQRVVYPITFGGGTKVEIKGGGGSGGGGSGGGGSGGGGSQIT<br>LKESGPTLVKPTQTLTLTCTFSGFSLSTSGVGVGWIRQPPGKALEWLALIYWNDEKRYSPSLKSR<br>LTITKDTSKNQVVLTMTNMDPVDTAVYYCARDEYGGFDIWGQGTMVTVSSLEPKSCDKTHTCPPC<br>PIYIWAPLAGTCGVLLLSLVITLYCTKKKYSSSVHDPNGEYMEMRAVNTAKKSRLTDVTLRVKFS<br>RSADAPAYQQGQNQLYNELNLGRREEYDVLDKRRGRDPEMGGKPRRKNPQEGLYNELQKDKMAEA<br>YSEIGMKGERRRGKGHDGLYQGLSTATKDTYDALHMQALPPR |
| 210 | EIVLTQSPATLSLSPGERATLSCRASQSVSSYLAWYQQKPGQAPRLLIYDASNRATGIPARFSGS<br>GSGTDFTLTISSLEPEDFAVYYCQQRVVYPITFGGGTKVEIKGGGGSGGGGSGGGGSGGGGSQIT<br>LKESGPTLVKPTQTLTLTCTFSGFSLSTSGVGVGWIRQPPGKALEWLALIYWNDEKRYSPSLKSR<br>LTITKDTSKNQVVLTMTNMDPVDTAVYYCARDEYGGFDIWGQGTMVTVSSLEPKSCDKTHTCPPC<br>PFWVLVVVGGVLACYSLLVTVAFIIFWVKRGRKKLLYIFKQPEMRPVQTTQEEDGCSCRFPEEEE<br>GGCELRVKFSRSADAPAYQQGQNQLYNELNLGRREEYDVLDKRRGRDPEMGGKPRRKNPQEGLYN<br>ELQKDKMAEAYSEIGMKGERRRGKGHDGLYQGLSTATKDTYDALHMQALPPR |
| 211 | EIVLTQSPATLSLSPGERATLSCRASQSVSSYLAWYQQKPGQAPRLLIYDASNRATGIPARESGS<br>GSGTDFTLTISSLEPEDFAVYYCQQRVVYPITFGGGTKVEIKGGGGSGGGGSGGGGSGGGGSQIT<br>LKESGPTLVKPTQTLTLTCTFSGFSLSTSGVGVGWIRQPPGKALEWLALIYWNDEKRYSPSLKSR<br>LTITKDTSKNQVVLTMTNMDPVDTAVYYCARDEYGGFDIWGQGTMVTVSSLEPKSCDKTHTCPPC<br>PFWVLVVVGGVLACYSLLVTVAFIIFWVRSKRSRLLHSDYMNMTPRRPGPTRKHYQPYAPPRDFA<br>AYRSRVKFSRSADAPAYQQGQNQLYNELNLGRREEYDVLDKRRGRDPEMGGKPRRKNPQEGLYNE<br>LQKDKMAEAYSEIGMKGERRRGKGHDGLYQGLSTATKDTYDALHMQALPPR |
| 212 | EIVLTQSPATLSLSPGERATLSCRASQSVSSYLAWYQQKPGQAPRLLIYDASNRATGIPARFSGS<br>GSGTDFTLTISSLEPEDFAVYYCQQRVVYPITFGGGTKVEIKGGGGSGGGGSGGGGSGGGGSQIT<br>LKESGPTLVKPTQTLTLTCTFSGFSLSTSGVGVGWIRQPPGKALEWLALIYWNDEKRYSPSLKSR<br>LTITKDTSKNQVVLTMTNMDPVDTAVYYCARDEYGGFDIWGQGTMVTVSSLEPKSCDKTHTCPPC<br>PFWVLVVVGGVLACYSLLVTVAFIIFWVTKKKYSSSVHDPNGEYMEMRAVNTAKKSRLTDVTLRV<br>KFSRSADAPAYQQGQNQLYNELNLGRREEYDVLDKRRGRDPEMGGKPRRKNPQEGLYNELQKDKM<br>AEAYSEIGMKGERRRGKGHDGLYQGLSTATKDTYDALHMQALPPR |

In particular embodiments, a CAR comprises an antibody or antigen binding fragment thereof comprising an amino acid sequence set forth in SEQ ID NO: 29 or SEQ ID NO: 30; a spacer domain comprising an amino acid sequence set forth in SEQ ID NO: 145, SEQ ID NO: 146, SEQ ID NO: 148, or SEQ ID NO: 150; a transmembrane domain comprising an amino acid sequence set forth in SEQ ID NO: 151 or SEQ ID NO: 153; a costimulatory domain comprising an amino acid sequence set forth in SEQ ID NO: 159, SEQ ID NO: 160, or SEQ ID NO: 162; and a primary signaling domain comprising an amino acid sequence set forth in SEQ ID NO: 158. In particular embodiments, a CAR comprises an amino acid sequence set forth in any one of SEQ ID NOs: 213, 214, 215, 216, 217, 218, 219, 220, 221, 222, 223, 224, 225, 226, 227, 228, 229, 230, 231, 232, 233, 234, 235, and 236. In particular embodiments, a CAR comprises an amino acid sequence set forth in any one of SEQ ID NOs: 237, 238, 239, 240, 241, 242, 243, 244, 245, 246, 247, 248, 249, 250, 251, 252, 253, 254, 255, 256, 257, 258, 259, and 260.

| SEQ ID NO. | AMINO ACID SEQUENCE |
|---|---|
| 213 | QITLKESGPTLVKPTQTLTLTCTFSGFSLSTSGVGVGWIRQPPGKALEWLALIYWNDDKRYSPSL<br>KSRLTITKDTSKNQVVLTMTNMDPVDTAVYYCARDEYGGFDIWGQGTMVTVSSGGGGSGGGGSGG<br>GGSGGGGSEIVLTQSPATLSLSPGERATLSCRASQSVSSYLAWYQQKPGQAPRLLIYDASNRATG<br>IPARFSGSGSGTDFTLTISSLEPEDFAVYYCQQRFDYPITFGGGTKVEIKTTTPAPRPPTPAPTI<br>ASQPLSLRPEACRPAAGGAVHTRGLDFACDIYIWAPLAGTCGVLLLSLVITLYCKRGRKKLLYIF<br>KQPFMRPVQTTQEEDGCSCRFPEEEEGGCELRVKFSRSADAPAYQQGQNQLYNELNLGRREEYDV<br>LDKRRGRDPEMGGKPRRKNPQEGLYNELQKDKMAEAYSEIGMKGERRRGKGHDGLYQGLSTATKD<br>TYDALHMQALPPR |
| 214 | QITLKESGPTLVKPTQTLTLTCTFSGFSLSTSGVGVGWIRQPPGKALEWLALIYWNDDKRYSPSL<br>KSRLTITKDTSKNQVVLTMTNMDPVDTAVYYCARDEYGGFDIWGQGTMVTVSSGGGGSGGGGSGG<br>GGSGGGGSEIVLTQSPATLSLSPGERATLSCRASQSVSSYLAWYQQKPGQAPRLLIYDASNRATG<br>IPARFSGSGSGTDFTLTISSLEPEDFAVYYCQQRFDYPITFGGGTKVEIKTTTPAPRPPTPAPTI<br>ASQPLSLRPEACRPAAGGAVHTRGLDFACDIYIWAPLAGTCGVLLLSLVITLYCRSKRSRLLHSD<br>YMNMTPRRPGPTRKHYQPYAPPRDFAAYRSRVKFSRSADAPAYQQGQNQLYNELNLGRREEYDVL<br>DKRRGRDPEMGGKPRRKNPQEGLYNELQKDKMAEAYSEIGMKGERRRGKGHDGLYQGLSTATKDT<br>YDALHMQALPPR |
| 215 | QITLKESGPTLVKPTQTLTLTCTFSGFSLSTSGVGVGWIRQPPGKALEWLALIYWNDDKRYSPSL<br>KSRLTITKDTSKNQVVLTMTNMDPVDTAVYYCARDEYGGFDIWGQGTMVTVSSGGGGSGGGGSGG<br>GGSGGGGSEIVLTQSPATLSLSPGERATLSCRASQSVSSYLAWYQQKPGQAPRLLIYDASNRATG<br>IPARFSGSGSGTDFTLTISSLEPEDFAVYYCQQRFDYPITFGGGTKVEIKTTTPAPRPPTPAPTI<br>ASQPLSLRPEACRPAAGGAVHTRGLDFACDIYIWAPLAGTCGVLLLSLVITLYCTKKKYSSSVHD<br>PNGEYMFMRAVNTAKKSRLTDVTLRVKFSRSADAPAYQQGQNQLYNELNLGRREEYDVLDKRRGR<br>DPEMGGKPRRKNPQEGLYNELQKDKMAEAYSEIGMKGERRRGKGHDGLYQGLSTATKDTYDALHM<br>QALPPR |
| 216 | QITLKESGPTLVKPTQTLTLTCTFSGFSLSTSGVGVGWIRQPPGKALEWLALIYWNDDKRYSPSL<br>KSRLTITKDTSKNQVVLTMTNMDPVDTAVYYCARDEYGGFDIWGQGTMVTVSSGGGGSGGGGSGG<br>GGSGGGGSEIVLTQSPATLSLSPGERATLSCRASQSVSSYLAWYQQKPGQAPRLLIYDASNRATG<br>IPARFSGSGSGTDFTLTISSLEPEDFAVYYCQQRFDYPITFGGGTKVEIKTTTPAPRPPTPAPTI<br>ASQPLSLRPEACRPAAGGAVHTRGLDFACDFWVLVVVGGVLACYSLLVTVAFIIFWVKRGRKKLL<br>YIFKQPFMRPVQTTQEEDGCSCRFPEEEEGGCELRVKFSRSADAPAYQQGQNQLYNELNLGRREE<br>YDVLDKRRGRDPEMGGKPRRKNPQEGLYNELQKDKMAEAYSEIGMKGERRRGKGHDGLYQGLSTA<br>TKDTYDALHMQALPPR |
| 217 | QITLKESGPTLVKPTQTLTLTCTFSGFSLSTSGVGVGWIRQPPGKALEWLALIYWNDDKRYSPSL<br>KSRLTITKDTSKNQVVLTMTNMDPVDTAVYYCARDEYGGFDIWGQGTMVTVSSGGGGSGGGGSGG<br>GGSGGGGSEIVLTQSPATLSLSPGERATLSCRASQSVSSYLAWYQQKPGQAPRLLIYDASNRATG<br>IPARFSGSGSGTDFTLTISSLEPEDFAVYYCQQRFDYPITFGGGTKVEIKTTTPAPRPPTPAPTI<br>ASQPLSLRPEACRPAAGGAVHTRGLDFACDFWVLVVVGGVLACYSLLVTVAFIIFWVRSKRSRLL<br>HSDYMNMTPRRPGPTRKHYQPYAPPRDFAAYRSRVKFSRSADAPAYQQGQNQLYNELNLGRREEY<br>DVLDKRRGRDPEMGGKPRRKNPQEGLYNELQKDKMAEAYSEIGMKGERRRGKGHDGLYQGLSTAT<br>KDTYDALHMQALPPR |
| 218 | QITLKESGPTLVKPTQTLTLTCTFSGFSLSTSGVGVGWIRQPPGKALEWLALIYWNDDKRYSPSL<br>KSRLTITKDTSKNQVVLTMTNMDPVDTAVYYCARDEYGGFDIWGQGTMVTVSSGGGGSGGGGSGG<br>GGSGGGGSEIVLTQSPATLSLSPGERATLSCRASQSVSSYLAWYQQKPGQAPRLLIYDASNRATG<br>IPARFSGSGSGTDFTLTISSLEPEDFAVYYCQQRFDYPITFGGGTKVEIKTTTPAPRPPTPAPTI<br>ASQPLSLRPEACRPAAGGAVHTRGLDFACDFWVLVVVGGVLACYSLLVTVAFIIFWVTKKKYSSS<br>VHDPNGEYMFMRAVNTAKKSRLTDVTLRVKFSRSADAPAYQQGQNQLYNELNLGRREEYDVLDKR<br>RGRDPEMGGKPRRKNPQEGLYNELQKDKMAEAYSEIGMKGERRRGKGHDGLYQGLSTATKDTYDA<br>LHMQALPPR |
| 219 | QITLKESGPTLVKPTQTLTLTCTFSGFSLSTSGVGVGWIRQPPGKALEWLALIYWNDDKRYSPSL<br>KSRLTITKDTSKNQVVLTMTNMDPVDTAVYYCARDEYGGFDIWGQGTMVTVSSGGGGSGGGGSGG<br>GGSGGGGSEIVLTQSPATLSLSPGERATLSCRASQSVSSYLAWYQQKPGQAPRLLIYDASNRATG<br>IPARFSGSGSGTDFTLTISSLEPEDFAVYYCQQRFDYPITFGGGTKVEIKIEVMYPPPYLDNEKS<br>NGTIIHVKGKHLCPSPLFPGPSKPIYIWAPLAGTCGVLLLSLVITLYCKRGRKKLLYIFKQPFMR<br>PVQTTQEEDGCSCRFPEEEEGGCELRVKFSRSADAPAYQQGQNQLYNELNLGRREEYDVLDKRRG<br>RDPEMGGKPRRKNPQEGLYNELQKDKMAEAYSEIGMKGERRRGKGHDGLYQGLSTATKDTYDALH<br>MQALPPR |

-continued

| SEQ ID NO. | AMINO ACID SEQUENCE |
|---|---|
| 220 | QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 221 | QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 222 | QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 223 | QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 224 | QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 225 | QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 226 | QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 227 | QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQREDYPITFGGGTKVEIKESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 228 | QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKESKYGPPCPPCPFWVLVVVGGVLACYSLLVTVAFIIFWVKRGRKKLLYIFKQPEMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |

-continued

| SEQ ID NO. | AMINO ACID SEQUENCE |
|---|---|
| 229 | QITLKESGPTLVKPTQTLTLTCTFSGFSLSTSGVGVGWIRQPPGKALEWLALIYWNDDKRYSPSL KSRLTITKDTSKNQVVLTMTNMDPVDTAVYYCARDEYGGFDIWGQGTMVTVSSGGGGSGGGGSGG GGSGGGGSEIVLTQSPATLSLSPGERATLSCRASQSVSSYLAWYQQKPGQAPRLLIYDASNRATG IPARFSGSGSGTDFTLTISSLEPEDFAVYYCQQRFDYPITFGGGTKVEIKESKYGPPCPPCPFWV LVVVGGVLACYSLLVTVAFIIFWVRSKRSRLLHSDYMNMTPRRPGPTRKHYQPYAPPRDFAAYRS RVKFSRSADAPAYQQGQNQLYNELNLGRREEYDVLDKRRGRDPEMGGKPRRKNPQEGLYNELQKD KMAEAYSEIGMKGERRRGKGHDGLYQGLSTATKDTYDALHMQALPPR |
| 230 | QITLKESGPTLVKPTQTLTLTCTFSGFSLSTSGVGVGWIRQPPGKALEWLALIYWNDDKRYSPSL KSRLTITKDTSKNQVVLTMTNMDPVDTAVYYCARDEYGGFDIWGQGTMVTVSSGGGGSGGGGSGG GGSGGGGSEIVLTQSPATLSLSPGERATLSCRASQSVSSYLAWYQQKPGQAPRLLIYDASNRATG IPARFSGSGSGTDFTLTISSLEPEDFAVYYCQQRFDYPITFGGGTKVEIKESKYGPPCPPCPFWV LVVVGGVLACYSLLVTVAFIIFWVTKKKYSSSVHDPNGEYMFMRAVNTAKKSRLTDVTLRVKFSR SADAPAYQQGQNQLYNELNLGRREEYDVLDKRRGRDPEMGGKPRRKNPQEGLYNELQKDKMAEAY SEIGMKGERRRGKGHDGLYQGLSTATKDTYDALHMQALPPR |
| 231 | QITLKESGPTLVKPTQTLTLTCTFSGFSLSTSGVGVGWIRQPPGKALEWLALIYWNDDKRYSPSL KSRLTITKDTSKNQVVLTMTNMDPVDTAVYYCARDEYGGFDIWGQGTMVTVSSGGGGSGGGGSGG GGSGGGGSEIVLTQSPATLSLSPGERATLSCRASQSVSSYLAWYQQKPGQAPRLLIYDASNRATG IPARFSGSGSGTDFTLTISSLEPEDFAVYYCQQRFDYPITFGGGTKVEIKLEPKSCDKTHTCPPC PIYIWAPLAGTCGVLLLSLVITLYCKRGRKKLLYIFKQPEMRPVQTTQEEDGCSCRFPEEEEGGC ELRVKFSRSADAPAYQQGQNQLYNELNLGRREEYDVLDKRRGRDPEMGGKPRRKNPQEGLYNELQ KDKMAEAYSEIGMKGERRRGKGHDGLYQGLSTATKDTYDALHMQALPPR |
| 232 | QITLKESGPTLVKPTQTLTLTCTFSGFSLSTSGVGVGWIRQPPGKALEWLALIYWNDDKRYSPSL KSRLTITKDTSKNQVVLTMTNMDPVDTAVYYCARDEYGGFDIWGQGTMVTVSSGGGGSGGGGSGG GGSGGGGSEIVLTQSPATLSLSPGERATLSCRASQSVSSYLAWYQQKPGQAPRLLIYDASNRATG IPARFSGSGSGTDFTLTISSLEPEDFAVYYCQQRFDYPITFGGGTKVEIKLEPKSCDKTHTCPPC PIYIWAPLAGTCGVLLLSLVITLYCRSKRSRLLHSDYMNMTPRRPGPTRKHYQPYAPPRDFAAYR SRVKFSRSADAPAYQQGQNQLYNELNLGRREEYDVLDKRRGRDPEMGGKPRRKNPQEGLYNELQK DKMAEAYSEIGMKGERRRGKGHDGLYQGLSTATKDTYDALHMQALPPR |
| 233 | QITLKESGPTLVKPTQTLTLTCTFSGFSLSTSGVGVGWIRQPPGKALEWLALIYWNDDKRYSPSL KSRLTITKDTSKNQVVLTMTNMDPVDTAVYYCARDEYGGFDIWGQGTMVTVSSGGGGSGGGGSGG GGSGGGGSEIVLTQSPATLSLSPGERATLSCRASQSVSSYLAWYQQKPGQAPRLLIYDASNRATG IPARFSGSGSGTDFTLTISSLEPEDFAVYYCQQRFDYPITFGGGTKVEIKLEPKSCDKTHTCPPC PIYIWAPLAGTCGVLLLSLVITLYCTKKKYSSSVHDPNGEYMFMRAVNTAKKSRLTDVTLRVKFS RSADAPAYQQGQNQLYNELNLGRREEYDVLDKRRGRDPEMGGKPRRKNPQEGLYNELQKDKMAEA YSEIGMKGERRRGKGHDGLYQGLSTATKDTYDALHMQALPPR |
| 234 | QITLKESGPTLVKPTQTLTLTCTFSGFSLSTSGVGVGWIRQPPGKALEWLALIYWNDDKRYSPSL KSRLTITKDTSKNQVVLTMTNMDPVDTAVYYCARDEYGGFDIWGQGTMVTVSSGGGGSGGGGSGG GGSGGGGSEIVLTQSPATLSLSPGERATLSCRASQSVSSYLAWYQQKPGQAPRLLIYDASNRATG IPARFSGSGSGTDFTLTISSLEPEDFAVYYCQQRFDYPITFGGGTKVEIKLEPKSCDKTHTCPPC PFWVLVVVGGVLACYSLLVTVAFIIFWVKRGRKKLLYIFKQPEMRPVQTTQEEDGCSCRFPEEEE GGCELRVKFSRSADAPAYQQGQNQLYNELNLGRREEYDVLDKRRGRDPEMGGKPRRKNPQEGLYN ELQKDKMAEAYSEIGMKGERRRGKGHDGLYQGLSTATKDTYDALHMQALPPR |
| 235 | QITLKESGPTLVKPTQTLTLTCTFSGFSLSTSGVGVGWIRQPPGKALEWLALIYWNDDKRYSPSL KSRLTITKDTSKNQVVLTMTNMDPVDTAVYYCARDEYGGFDIWGQGTMVTVSSGGGGSGGGGSGG GGSGGGGSEIVLTQSPATLSLSPGERATLSCRASQSVSSYLAWYQQKPGQAPRLLIYDASNRATG IPARFSGSGSGTDFTLTISSLEPEDFAVYYCQQRFDYPITFGGGTKVEIKLEPKSCDKTHTCPPC PFWVLVVVGGVLACYSLLVTVAFIIFWVRSKRSRLLHSDYMNMTPRRPGPTRKHYQPYAPPRDFA AYRSRVKFSRSADAPAYQQGQNQLYNELNLGRREEYDVLDKRRGRDPEMGGKPRRKNPQEGLYNE LQKDKMAEAYSEIGMKGERRRGKGHDGLYQGLSTATKDTYDALHMQALPPR |
| 236 | QITLKESGPTLVKPTQTLTLTCTFSGFSLSTSGVGVGWIRQPPGKALEWLALIYWNDDKRYSPSL KSRLTITKDTSKNQVVLTMTNMDPVDTAVYYCARDEYGGFDIWGQGTMVTVSSGGGGSGGGGSGG GGSGGGGSEIVLTQSPATLSLSPGERATLSCRASQSVSSYLAWYQQKPGQAPRLLIYDASNRATG IPARFSGSGSGTDFTLTISSLEPEDFAVYYCQQRFDYPITFGGGTKVEIKLEPKSCDKTHTCPPC PFWVLVVVGGVLACYSLLVTVAFIIFWVTKKKYSSSVHDPNGEYMFMRAVNTAKKSRLTDVTLRV KFSRSADAPAYQQGQNQLYNELNLGRREEYDVLDKRRGRDPEMGGKPRRKNPQEGLYNELQKDKM AEAYSEIGMKGERRRGKGHDGLYQGLSTATKDTYDALHMQALPPR |
| 237 | EIVLTQSPATLSLSPGERATLSCRASQSVSSYLAWYQQKPGQAPRLLIYDASNRATGIPARFSGS GSGTDFTLTISSLEPEDFAVYYCQQRFDYPITFGGGTKVEIKGGGGSGGGGSGGGGSGGGGSQIT LKESGPTLVKPTQTLTLTCTFSGFSLSTSGVGVGWIRQPPGKALEWLALIYWNDDKRYSPSLKSR LTITKDTSKNQVVLTMTNMDPVDTAVYYCARDEYGGFDIWGQGTMVTVSSTTTPAPRPPTPAPTI ASQPLSLRPEACRPAAGGAVHTRGLDFACDIYIWAPLAGTCGVLLLSLVITLYCKRGRKKLLYIF KQPFMRPVQTTQEEDGCSCRFPEEEEGGCELRVKFSRSADAPAYQQGQNQLYNELNLGRREEYDV LDKRRGRDPEMGGKPRRKNPQEGLYNELQKDKMAEAYSEIGMKGERRRGKGHDGLYQGLSTATKD TYDALHMQALPPR |

-continued

| SEQ ID NO. | AMINO ACID SEQUENCE |
|---|---|
| 238 | EIVLTQSPATLSLSPGERATLSCRASQSVSSYLAWYQQKPGQAPRLLIYDASNRATGIPARFSGS GSGTDFTLTISSLEPEDFAVYYCQQRFDYPITFGGGTKVEIKGGGGSGGGGSGGGGSGGGGSQIT LKESGPTLVKPTQTLTLTCTFSGFSLSTSGVGVGWIRQPPGKALEWLALIYWNDDKRYSPSLKSR LTITKDTSKNQVVLTMTNMDPVDTAVYYCARDEYGGFDIWGQGTMVTVSSTTTPAPRPPTPAPTI ASQPLSLRPEACRPAAGGAVHTRGLDFACDIYIWAPLAGTCGVLLLSLVITLYCRSKRSRLLHSD YMNMTPRRPGPTRKHYQPYAPPRDFAAYRSRVKFSRSADAPAYQQGQNQLYNELNLGRREEYDVL DKRRGRDPEMGGKPRRKNPQEGLYNELQKDKMAEAYSEIGMKGERRRGKGHDGLYQGLSTATKDT YDALHMQALPPR |
| 239 | EIVLTQSPATLSLSPGERATLSCRASQSVSSYLAWYQQKPGQAPRLLIYDASNRATGIPARFSGS GSGTDFTLTISSLEPEDFAVYYCQQRFDYPITFGGGTKVEIKGGGGSGGGGSGGGGSGGGGSQIT LKESGPTLVKPTQTLTLTCTFSGFSLSTSGVGVGWIRQPPGKALEWLALIYWNDDKRYSPSLKSR LTITKDTSKNQVVLTMTNMDPVDTAVYYCARDEYGGFDIWGQGTMVTVSSTTTPAPRPPTPAPTI ASQPLSLRPEACRPAAGGAVHTRGLDFACDIYIWAPLAGTCGVLLLSLVITLYCTKKKYSSSVHD PNGEYMFMRAVNTAKKSRLTDVTLRVKFSRSADAPAYQQGQNQLYNELNLGRREEYDVLDKRRGR DPEMGGKPRRKNPQEGLYNELQKDKMAEAYSEIGMKGERRRGKGHDGLYQGLSTATKDTYDALHM QALPPR |
| 240 | EIVLTQSPATLSLSPGERATLSCRASQSVSSYLAWYQQKPGQAPRLLIYDASNRATGIPARFSGS GSGTDFTLTISSLEPEDFAVYYCQQRFDYPITFGGGTKVEIKGGGGSGGGGSGGGGSGGGGSQIT LKESGPTLVKPTQTLTLTCTFSGFSLSTSGVGVGWIRQPPGKALEWLALIYWNDDKRYSPSLKSR LTITKDTSKNQVVLTMTNMDPVDTAVYYCARDEYGGFDIWGQGTMVTVSSTTTPAPRPPTPAPTI ASQPLSLRPEACRPAAGGAVHTRGLDFACDFWVLVVVGGVLACYSLLVTVAFIIFWVKRGRKKLL YIFKQPFMRPVQTTQEEDGCSCRFPEEEEGGCELRVKFSRSADAPAYQQGQNQLYNELNLGRREE YDVLDKRRGRDPEMGGKPRRKNPQEGLYNELQKDKMAEAYSEIGMKGERRRGKGHDGLYQGLSTA TKDTYDALHMQALPPR |
| 241 | EIVLTQSPATLSLSPGERATLSCRASQSVSSYLAWYQQKPGQAPRLLIYDASNRATGIPARFSGS GSGTDFTLTISSLEPEDFAVYYCQQRFDYPITFGGGTKVEIKGGGGSGGGGSGGGGSGGGGSQIT LKESGPTLVKPTQTLTLTCTFSGFSLSTSGVGVGWIRQPPGKALEWLALIYWNDDKRYSPSLKSR LTITKDTSKNQVVLTMTNMDPVDTAVYYCARDEYGGFDIWGQGTMVTVSSTTTPAPRPPTPAPTI ASQPLSLRPEACRPAAGGAVHTRGLDFACDFWVLVVVGGVLACYSLLVTVAFIIFWVRSKRSRLL HSDYMNMTPRRPGPTRKHYQPYAPPRDFAAYRSRVKFSRSADAPAYQQGQNQLYNELNLGRREEY DVLDKRRGRDPEMGGKPRRKNPQEGLYNELQKDKMAEAYSEIGMKGERRRGKGHDGLYQGLSTAT KDTYDALHMQALPPR |
| 242 | EIVLTQSPATLSLSPGERATLSCRASQSVSSYLAWYQQKPGQAPRLLIYDASNRATGIPARFSGS GSGTDFTLTISSLEPEDFAVYYCQQRFDYPITFGGGTKVEIKGGGGSGGGGSGGGGSGGGGSQIT LKESGPTLVKPTQTLTLTCTFSGFSLSTSGVGVGWIRQPPGKALEWLALIYWNDDKRYSPSLKSR LTITKDTSKNQVVLTMTNMDPVDTAVYYCARDEYGGFDIWGQGTMVTVSSTTTPAPRPPTPAPTI ASQPLSLRPEACRPAAGGAVHTRGLDFACDFWVLVVVGGVLACYSLLVTVAFIIFWVTKKKYSSS VHDPNGEYMFMRAVNTAKKSRLTDVTLRVKFSRSADAPAYQQGQNQLYNELNLGRREEYDVLDKR RGRDPEMGGKPRRKNPQEGLYNELQKDKMAEAYSEIGMKGERRRGKGHDGLYQGLSTATKDTYDA LHMQALPPR |
| 243 | EIVLTQSPATLSLSPGERATLSCRASQSVSSYLAWYQQKPGQAPRLLIYDASNRATGIPARFSGS GSGTDFTLTISSLEPEDFAVYYCQQRFDYPITFGGGTKVEIKGGGGSGGGGSGGGGSGGGGSQIT LKESGPTLVKPTQTLTLTCTFSGFSLSTSGVGVGWIRQPPGKALEWLALIYWNDDKRYSPSLKSR LTITKDTSKNQVVLTMTNMDPVDTAVYYCARDEYGGFDIWGQGTMVTVSSIEVMYPPPYLDNEKS NGTIIHVKGKHLCPSPLFPGPSKPIYIWAPLAGTCGVLLLSLVITLYCKRGRKKLLYIFKQPFMR PVQTTQEEDGCSCRFPEEEEGGCELRVKFSRSADAPAYQQGQNQLYNELNLGRREEYDVLDKRRG RDPEMGGKPRRKNPQEGLYNELQKDKMAEAYSEIGMKGERRRGKGHDGLYQGLSTATKDTYDALH MQALPPR |
| 244 | EIVLTQSPATLSLSPGERATLSCRASQSVSSYLAWYQQKPGQAPRLLIYDASNRATGIPARFSGS GSGTDFTLTISSLEPEDFAVYYCQQRFDYPITFGGGTKVEIKGGGGSGGGGSGGGGSGGGGSQIT LKESGPTLVKPTQTLTLTCTFSGFSLSTSGVGVGWIRQPPGKALEWLALIYWNDDKRYSPSLKSR LTITKDTSKNQVVLTMTNMDPVDTAVYYCARDEYGGFDIWGQGTMVTVSSIEVMYPPPYLDNEKS NGTIIHVKGKHLCPSPLFPGPSKPIYIWAPLAGTCGVLLLSLVITLYCRSKRSRLLHSDYMNMTP RRPGPTRKHYQPYAPPRDFAAYRSRVKFSRSADAPAYQQGQNQLYNELNLGRREEYDVLDKRRGR DPEMGGKPRRKNPQEGLYNELQKDKMAEAYSEIGMKGERRRGKGHDGLYQGLSTATKDTYDALHM QALPPR |
| 245 | EIVLTQSPATLSLSPGERATLSCRASQSVSSYLAWYQQKPGQAPRLLIYDASNRATGIPARFSGS GSGTDFTLTISSLEPEDFAVYYCQQRFDYPITFGGGTKVEIKGGGGSGGGGSGGGGSGGGGSQIT LKESGPTLVKPTQTLTLTCTFSGFSLSTSGVGVGWIRQPPGKALEWLALIYWNDDKRYSPSLKSR LTITKDTSKNQVVLTMTNMDPVDTAVYYCARDEYGGFDIWGQGTMVTVSSIEVMYPPPYLDNEKS NGTIIHVKGKHLCPSPLFPGPSKPIYIWAPLAGTCGVLLLSLVITLYCTKKKYSSSVHDPNGEYM FMRAVNTAKKSRLTDVTLRVKFSRSADAPAYQQGQNQLYNELNLGRREEYDVLDKRRGRDPEMGG KPRRKNPQEGLYNELQKDKMAEAYSEIGMKGERRRGKGHDGLYQGLSTATKDTYDALHMQALPPR |
| 246 | EIVLTQSPATLSLSPGERATLSCRASQSVSSYLAWYQQKPGQAPRLLIYDASNRATGIPARFSGS GSGTDFTLTISSLEPEDFAVYYCQQRFDYPITFGGGTKVEIKGGGGSGGGGSGGGGSGGGGSQIT LKESGPTLVKPTQTLTLTCTFSGFSLSTSGVGVGWIRQPPGKALEWLALIYWNDDKRYSPSLKSR |

-continued

| SEQ ID NO. | AMINO ACID SEQUENCE |
|---|---|
| | LTITKDTSKNQVVLTMTNMDPVDTAVYYCARDEYGGFDIWGQGTMVTVSSIEVMYPPPYLDNEKS<br>NGTIIHVKGKHLCPSPLFPGPSKPFWVLVVVGGVLACYSLLVTVAFIIFWVKRGRKKLLYIFKQP<br>FMRPVQTTQEEDGCSCRFPEEEEGGCELRVKFSRSADAPAYQQGQNQLYNELNLGRREEYDVLDK<br>RRGRDPEMGGKPRRKNPQEGLYNELQKDKMAEAYSEIGMKGERRRGKGHDGLYQGLSTATKDTYD<br>ALHMQALPPR |
| 247 | EIVLTQSPATLSLSPGERATLSCRASQSVSSYLAWYQQKPGQAPRLLIYDASNRATGIPARFSGS<br>GSGTDFTLTISSLEPEDFAVYYCQQRFDYPITFGGGTKVEIKGGGGSGGGGSGGGGSGGGGSQIT<br>LKESGPTLVKPTQTLTLTCTFSGFSLSTSGVGVGWIRQPPGKALEWLALIYWNDDKRYSPSLKSR<br>LTITKDTSKNQVVLTMTNMDPVDTAVYYCARDEYGGFDIWGQGTMVTVSSIEVMYPPPYLDNEKS<br>NGTIIHVKGKHLCPSPLFPGPSKPFWVLVVVGGVLACYSLLVTVAFIIFWVRSKRSRLLHSDYMN<br>MTPRRPGPTRKHYQPYAPPRDFAAYRSRVKFSRSADAPAYQQGQNQLYNELNLGRREEYDVLDKR<br>RGRDPEMGGKPRRKNPQEGLYNELQKDKMAEAYSEIGMKGERRRGKGHDGLYQGLSTATKDTYDA<br>LHMQALPPR |
| 248 | EIVLTQSPATLSLSPGERATLSCRASQSVSSYLAWYQQKPGQAPRLLIYDASNRATGIPARFSGS<br>GSGTDFTLTISSLEPEDFAVYYCQQRFDYPITFGGGTKVEIKGGGGSGGGGSGGGGSGGGGSQIT<br>LKESGPTLVKPTQTLTLTCTFSGFSLSTSGVGVGWIRQPPGKALEWLALIYWNDDKRYSPSLKSR<br>LTITKDTSKNQVVLTMTNMDPVDTAVYYCARDEYGGFDIWGQGTMVTVSSIEVMYPPPYLDNEKS<br>NGTIIHVKGKHLCPSPLFPGPSKPFWVLVVVGGVLACYSLLVTVAFIIFWVTKKKYSSSVHDPNG<br>EYMFMRAVNTAKKSRLTDVTLRVKFSRSADAPAYQQGQNQLYNELNLGRREEYDVLDKRRGRDPE<br>MGGKPRRKNPQEGLYNELQKDKMAEAYSEIGMKGERRRGKGHDGLYQGLSTATKDTYDALHMQAL<br>PPR |
| 249 | EIVLTQSPATLSLSPGERATLSCRASQSVSSYLAWYQQKPGQAPRLLIYDASNRATGIPARFSGS<br>GSGTDFTLTISSLEPEDFAVYYCQQRFDYPITFGGGTKVEIKGGGGSGGGGSGGGGSGGGGSQIT<br>LKESGPTLVKPTQTLTLTCTFSGFSLSTSGVGVGWIRQPPGKALEWLALIYWNDDKRYSPSLKSR<br>LTITKDTSKNQVVLTMTNMDPVDTAVYYCARDEYGGFDIWGQGTMVTVSSESKYGPPCPPCPIYI<br>WAPLAGTCGVLLLSLVITLYCKRGRKKLLYIFKQPEMRPVQTTQEEDGCSCRFPEEEEGGCELRV<br>KFSRSADAPAYQQGQNQLYNELNLGRREEYDVLDKRRGRDPEMGGKPRRKNPQEGLYNELQKDKM<br>AEAYSEIGMKGERRRGKGHDGLYQGLSTATKDTYDALHMQALPPR |
| 250 | EIVLTQSPATLSLSPGERATLSCRASQSVSSYLAWYQQKPGQAPRLLIYDASNRATGIPARFSGS<br>GSGTDFTLTISSLEPEDFAVYYCQQRFDYPITFGGGTKVEIKGGGGSGGGGSGGGGSGGGGSQIT<br>LKESGPTLVKPTQTLTLTCTFSGFSLSTSGVGVGWIRQPPGKALEWLALIYWNDDKRYSPSLKSR<br>LTITKDTSKNQVVLTMTNMDPVDTAVYYCARDEYGGFDIWGQGTMVTVSSESKYGPPCPPCPIYI<br>WAPLAGTCGVLLLSLVITLYCRSKRSRLLHSDYMNMTPRRPGPTRKHYQPYAPPRDFAAYRSRVK<br>FSRSADAPAYQQGQNQLYNELNLGRREEYDVLDKRRGRDPEMGGKPRRKNPQEGLYNELQKDKMA<br>EAYSEIGMKGERRRGKGHDGLYQGLSTATKDTYDALHMQALPPR |
| 251 | EIVLTQSPATLSLSPGERATLSCRASQSVSSYLAWYQQKPGQAPRLLIYDASNRATGIPARFSGS<br>GSGTDFTLTISSLEPEDFAVYYCQQRFDYPITFGGGTKVEIKGGGGSGGGGSGGGGSGGGGSQIT<br>LKESGPTLVKPTQTLTLTCTFSGFSLSTSGVGVGWIRQPPGKALEWLALIYWNDDKRYSPSLKSR<br>LTITKDTSKNQVVLTMTNMDPVDTAVYYCARDEYGGFDIWGQGTMVTVSSESKYGPPCPPCPIYI<br>WAPLAGTCGVLLLSLVITLYCTKKKYSSSVHDPNGEYMFMRAVNTAKKSRLTDVTLRVKFSRSAD<br>APAYQQGQNQLYNELNLGRREEYDVLDKRRGRDPEMGGKPRRKNPQEGLYNELQKDKMAEAYSEI<br>GMKGERRRGKGHDGLYQGLSTATKDTYDALHMQALPPR |
| 252 | EIVLTQSPATLSLSPGERATLSCRASQSVSSYLAWYQQKPGQAPRLLIYDASNRATGIPARFSGS<br>GSGTDFTLTISSLEPEDFAVYYCQQRFDYPITFGGGTKVEIKGGGGSGGGGSGGGGSGGGGSQIT<br>LKESGPTLVKPTQTLTLTCTFSGFSLSTSGVGVGWIRQPPGKALEWLALIYWNDDKRYSPSLKSR<br>LTITKDTSKNQVVLTMTNMDPVDTAVYYCARDEYGGFDIWGQGTMVTVSSESKYGPPCPPCPFWV<br>LVVVGGVLACYSLLVTVAFIIFWVKRGRKKLLYIFKQPFMRPVQTTQEEDGCSCRFPEEEEGGCE<br>LRVKFSRSADAPAYQQGQNQLYNELNLGRREEYDVLDKRRGRDPEMGGKPRRKNPQEGLYNELQK<br>DKMAEAYSEIGMKGERRRGKGHDGLYQGLSTATKDTYDALHMQALPPR |
| 253 | EIVLTQSPATLSLSPGERATLSCRASQSVSSYLAWYQQKPGQAPRLLIYDASNRATGIPARFSGS<br>GSGTDFTLTISSLEPEDFAVYYCQQRFDYPITFGGGTKVEIKGGGGSGGGGSGGGGSGGGGSQIT<br>LKESGPTLVKPTQTLTLTCTFSGFSLSTSGVGVGWIRQPPGKALEWLALIYWNDDKRYSPSLKSR<br>LTITKDTSKNQVVLTMTNMDPVDTAVYYCARDEYGGFDIWGQGTMVTVSSESKYGPPCPPCPFWV<br>LVVVGGVLACYSLLVTVAFIIFWVRSKRSRLLHSDYMNMTPRRPGPTRKHYQPYAPPRDFAAYRS<br>RVKFSRSADAPAYQQGQNQLYNELNLGRREEYDVLDKRRGRDPEMGGKPRRKNPQEGLYNELQKD<br>KMAEAYSEIGMKGERRRGKGHDGLYQGLSTATKDTYDALHMQALPPR |
| 254 | EIVLTQSPATLSLSPGERATLSCRASQSVSSYLAWYQQKPGQAPRLLIYDASNRATGIPARFSGS<br>GSGTDFTLTISSLEPEDFAVYYCQQRFDYPITFGGGTKVEIKGGGGSGGGGSGGGGSGGGGSQIT<br>LKESGPTLVKPTQTLTLTCTFSGFSLSTSGVGVGWIRQPPGKALEWLALIYWNDDKRYSPSLKSR<br>LTITKDTSKNQVVLTMTNMDPVDTAVYYCARDEYGGEDIWGQGTMVTVSSESKYGPPCPPCPFWV<br>LVVVGGVLACYSLLVTVAFIIFWVTKKKYSSSVHDPNGEYMFMRAVNTAKKSRLTDVTLRVKFSR<br>SADAPAYQQGQNQLYNELNLGRREEYDVLDKRRGRDPEMGGKPRRKNPQEGLYNELQKDKMAEAY<br>SEIGMKGERRRGKGHDGLYQGLSTATKDTYDALHMQALPPR |
| 255 | EIVLTQSPATLSLSPGERATLSCRASQSVSSYLAWYQQKPGQAPRLLIYDASNRATGIPARFSGS<br>GSGTDFTLTISSLEPEDFAVYYCQQRFDYPITFGGGTKVEIKGGGGSGGGGSGGGGSGGGGSQIT<br>LKESGPTLVKPTQTLTLTCTFSGFSLSTSGVGVGWIRQPPGKALEWLALIYWNDDKRYSPSLKSR |

-continued

| SEQ ID NO. | AMINO ACID SEQUENCE |
|---|---|
| | LTITKDTSKNQVVLTMTNMDPVDTAVYYCARDEYGGFDIWGQGTMVTVSSLEPKSCDKTHTCPPC<br>PIYIWAPLAGTCGVLLLSLVITLYCKRGRKKLLYIFKQPFMRPVQTTQEEDGCSCRFPEEEEGGC<br>ELRVKFSRSADAPAYQQGQNQLYNELNLGRREEYDVLDKRRGRDPEMGGKPRRKNPQEGLYNELQ<br>KDKMAEAYSEIGMKGERRRGKGHDGLYQGLSTATKDTYDALHMQALPPR |
| 256 | EIVLTQSPATLSLSPGERATLSCRASQSVSSYLAWYQQKPGQAPRLLIYDASNRATGIPARFSGS<br>GSGTDFTLTISSLEPEDFAVYYCQQRFDYPITFGGGTKVEIKGGGGSGGGGSGGGGSGGGGSQIT<br>LKESGPTLVKPTQTLTLTCTFSGFSLSTSGVGVGWIRQPPGKALEWLALIYWNDDKRYSPSLKSR<br>LTITKDTSKNQVVLTMTNMDPVDTAVYYCARDEYGGFDIWGQGTMVTVSSLEPKSCDKTHTCPPC<br>PIYIWAPLAGTCGVLLLSLVITLYCRSKRSRLLHSDYMNMTPRRPGPTRKHYQPYAPPRDFAAYR<br>SRVKFSRSADAPAYQQGQNQLYNELNLGRREEYDVLDKRRGRDPEMGGKPRRKNPQEGLYNELQK<br>DKMAEAYSEIGMKGERRRGKGHDGLYQGLSTATKDTYDALHMQALPPR |
| 257 | EIVLTQSPATLSLSPGERATLSCRASQSVSSYLAWYQQKPGQAPRLLIYDASNRATGIPARFSGS<br>GSGTDFTLTISSLEPEDFAVYYCQQRFDYPITFGGGTKVEIKGGGGSGGGGSGGGGSGGGGSQIT<br>LKESGPTLVKPTQTLTLTCTFSGFSLSTSGVGVGWIRQPPGKALEWLALIYWNDDKRYSPSLKSR<br>LTITKDTSKNQVVLTMTNMDPVDTAVYYCARDEYGGFDIWGQGTMVTVSSLEPKSCDKTHTCPPC<br>PIYIWAPLAGTCGVLLLSLVITLYCTKKKYSSSVHDPNGEYMFMRAVNTAKKSRLTDVTLRVKFS<br>RSADAPAYQQGQNQLYNELNLGRREEYDVLDKRRGRDPEMGGKPRRKNPQEGLYNELQKDKMAEA<br>YSEIGMKGERRRGKGHDGLYQGLSTATKDTYDALHMQALPPR |
| 258 | EIVLTQSPATLSLSPGERATLSCRASQSVSSYLAWYQQKPGQAPRLLIYDASNRATGIPARFSGS<br>GSGTDFTLTISSLEPEDFAVYYCQQRFDYPITFGGGTKVEIKGGGGSGGGGSGGGGSGGGGSQIT<br>LKESGPTLVKPTQTLTLTCTFSGFSLSTSGVGVGWIRQPPGKALEWLALIYWNDDKRYSPSLKSR<br>LTITKDTSKNQVVLTMTNMDPVDTAVYYCARDEYGGFDIWGQGTMVTVSSLEPKSCDKTHTCPPC<br>PFWVLVVVGGVLACYSLLVTVAFIIFWVKRGRKKLLYIFKQPEMRPVQTTQEEDGCSCRFPEEEE<br>GGCELRVKFSRSADAPAYQQGQNQLYNELNLGRREEYDVLDKRRGRDPEMGGKPRRKNPQEGLYN<br>ELQKDKMAEAYSEIGMKGERRRGKGHDGLYQGLSTATKDTYDALHMQALPPR |
| 259 | EIVLTQSPATLSLSPGERATLSCRASQSVSSYLAWYQQKPGQAPRLLIYDASNRATGIPARFSGS<br>GSGTDFTLTISSLEPEDFAVYYCQQRFDYPITFGGGTKVEIKGGGGSGGGGSGGGGSGGGGSQIT<br>LKESGPTLVKPTQTLTLTCTFSGFSLSTSGVGVGWIRQPPGKALEWLALIYWNDDKRYSPSLKSR<br>LTITKDTSKNQVVLTMTNMDPVDTAVYYCARDEYGGFDIWGQGTMVTVSSLEPKSCDKTHTCPPC<br>PFWVLVVVGGVLACYSLLVTVAFIIFWVRSKRSRLLHSDYMNMTPRRPGPTRKHYQPYAPPRDFA<br>AYRSRVKFSRSADAPAYQQGQNQLYNELNLGRREEYDVLDKRRGRDPEMGGKPRRKNPQEGLYNE<br>LQKDKMAEAYSEIGMKGERRRGKGHDGLYQGLSTATKDTYDALHMQALPPR |
| 260 | EIVLTQSPATLSLSPGERATLSCRASQSVSSYLAWYQQKPGQAPRLLIYDASNRATGIPARFSGS<br>GSGTDFTLTISSLEPEDFAVYYCQQRFDYPITFGGGTKVEIKGGGGSGGGGSGGGGSGGGGSQIT<br>LKESGPTLVKPTQTLTLTCTFSGFSLSTSGVGVGWIRQPPGKALEWLALIYWNDDKRYSPSLKSR<br>LTITKDTSKNQVVLTMTNMDPVDTAVYYCARDEYGGFDIWGQGTMVTVSSLEPKSCDKTHTCPPC<br>PFWVLVVVGGVLACYSLLVTVAFIIFWVTKKKYSSSVHDPNGEYMFMRAVNTAKKSRLTDVTLRV<br>KFSRSADAPAYQQGQNQLYNELNLGRREEYDVLDKRRGRDPEMGGKPRRKNPQEGLYNELQKDKM<br>AEAYSEIGMKGERRRGKGHDGLYQGLSTATKDTYDALHMQALPPR |

In preferred embodiments, a CAR comprises an antibody or antigen binding fragment thereof comprising an amino acid sequence set forth in SEQ ID NO: 39; a spacer domain comprising an amino acid sequence set forth in SEQ ID NO: 145, SEQ ID NO: 146, SEQ ID NO: 148, or SEQ ID NO: 150; a transmembrane domain comprising an amino acid sequence set forth in SEQ ID NO: 151 or SEQ ID NO: 153; a costimulatory domain comprising an amino acid sequence set forth in SEQ ID NO: 159, SEQ ID NO: 160, or SEQ ID NO: 162; and a primary signaling domain comprising an amino acid sequence set forth in SEQ ID NO: 158. In preferred embodiments, a CAR comprises an amino acid sequence set forth in any one of SEQ ID NOs: 261, 262, 263, 264, 265, 266, 267, 268, 269, 270, 271, 272, 273, 274, 275, 276, 277, 278, 279, 280, 281, 282, 283, and 284.

| SEQ ID NO. | AMINO ACID SEQUENCE |
|---|---|
| 261 | QVQLVESGGGVVQPGRSLRLSCAASGFTFSSYGMHWVRQAPGKGLEWVAVISYEGSNKYYADSVK<br>GRFTISRDNSKNTLYLQMNSLRAEDTAVYYCARELGDGMDVWGQGTTVTVSSGGGGSGGGGSGGG<br>GSGGGGSEIVLTQSPATLSLSPGERATLSCRASQSVSSYLAWFQQKPGQAPRLLIYDASNRATGI<br>PARFSGSGSGTDFTLTISSLEPEDFAVYYCQQRVDLWTFGGGTKVEIKTTTPAPRPPTPAPTIAS<br>QPLSLRPEACRPAAGGAVHTRGLDFACDIYIWAPLAGTCGVLLLSLVITLYCKRGRKKLLYIFKQ<br>PFMRPVQTTQEEDGCSCRFPEEEEGGCELRVKFSRSADAPAYQQGQNQLYNELNLGRREEYDVLD<br>KRRGRDPEMGGKPRRKNPQEGLYNELQKDKMAEAYSEIGMKGERRRGKGHDGLYQGLSTATKDTY<br>DALHMQALPPR |
| 262 | QVQLVESGGGVVQPGRSLRLSCAASGFTFSSYGMHWVRQAPGKGLEWVAVISYEGSNKYYADSVK<br>GRFTISRDNSKNTLYLQMNSLRAEDTAVYYCARELGDGMDVWGQGTTVTVSSGGGGSGGGGSGGG<br>GSGGGGSEIVLTQSPATLSLSPGERATLSCRASQSVSSYLAWFQQKPGQAPRLLIYDASNRATGI<br>PARFSGSGSGTDFTLTISSLEPEDFAVYYCQQRVDLWTFGGGTKVEIKTTTPAPRPPTPAPTIAS |

-continued

| SEQ ID NO. | AMINO ACID SEQUENCE |
|---|---|
| | QPLSLRPEACRPAAGGAVHTRGLDFACDIYIWAPLAGTCGVLLLSLVITLYCRSKRSRLLHSDYM NMTPRRPGPTRKHYQPYAPPRDFAAYRSRVKFSRSADAPAYQQGQNQLYNELNLGRREEYDVLDK RRGRDPEMGGKPRRKNPQEGLYNELQKDKMAEAYSEIGMKGERRRGKGHDGLYQGLSTATKDTYD ALHMQALPPR |
| 263 | QVQLVESGGGVVQPGRSLRLSCAASGFTFSSYGMHWVRQAPGKGLEWVAVISYEGSNKYYADSVK GRFTISRDNSKNTLYLQMNSLRAEDTAVYYCARELGDGMDVWGQGTTVTVSSGGGGSGGGGSGGG GSGGGGSEIVLTQSPATLSLSPGERATLSCRASQSVSSSYLAWFQQKPGQAPRLLIYDASNRATGI PARFSGSGSGTDFTLTISSLEPEDFAVYYCQQRVDLWTFGGGTKVEIKTTTPAPRPPTPAPTIAS QPLSLRPEACRPAAGGAVHTRGLDFACDIYIWAPLAGTCGVLLLSLVITLYCTKKKYSSSVHDPN GEYMFMRAVNTAKKSRLTDVTLRVKFSRSADAPAYQQGQNQLYNELNLGRREEYDVLDKRRGRDP EMGGKPRRKNPQEGLYNELQKDKMAEAYSEIGMKGERRRGKGHDGLYQGLSTATKDTYDALHMQA LPPR |
| 264 | QVQLVESGGGVVQPGRSLRLSCAASGFTFSSYGMHWVRQAPGKGLEWVAVISYEGSNKYYADSVK GRFTISRDNSKNTLYLQMNSLRAEDTAVYYCARELGDGMDVWGQGTTVTVSSGGGGSGGGGSGGG GSGGGGSEIVLTQSPATLSLSPGERATLSCRASQSVSSSYLAWFQQKPGQAPRLLIYDASNRATGI PARFSGSGSGTDFTLTISSLEPEDFAVYYCQQRVDLWTFGGGTKVEIKTTTPAPRPPTPAPTIAS QPLSLRPEACRPAAGGAVHTRGLDFACDFWVLVVVGGVLACYSLLVTVAFIIFWVKRGRKKLLYI FKQPFMRPVQTTQEEDGCSCRFPEEEEGGCELRVKFSRSADAPAYQQGQNQLYNELNLGRREEYD VLDKRRGRDPEMGGKPRRKNPQEGLYNELQKDKMAEAYSEIGMKGERRRGKGHDGLYQGLSTATK DTYDALHMQALPPR |
| 265 | QVQLVESGGGVVQPGRSLRLSCAASGFTFSSYGMHWVRQAPGKGLEWVAVISYEGSNKYYADSVK GRFTISRDNSKNTLYLQMNSLRAEDTAVYYCARELGDGMDVWGQGTTVTVSSGGGGSGGGGSGGG GSGGGGSEIVLTQSPATLSLSPGERATLSCRASQSVSSSYLAWFQQKPGQAPRLLIYDASNRATGI PARFSGSGSGTDFTLTISSLEPEDFAVYYCQQRVDLWTFGGGTKVEIKTTTPAPRPPTPAPTIAS QPLSLRPEACRPAAGGAVHTRGLDFACDFWVLVVVGGVLACYSLLVTVAFIIFWVRSKRSRLLHS DYMNMTPRRPGPTRKHYQPYAPPRDFAAYRSRVKFSRSADAPAYQQGQNQLYNELNLGRREEYDV LDKRRGRDPEMGGKPRRKNPQEGLYNELQKDKMAEAYSEIGMKGERRRGKGHDGLYQGLSTATKD TYDALHMQALPPR |
| 266 | QVQLVESGGGVVQPGRSLRLSCAASGFTFSSYGMHWVRQAPGKGLEWVAVISYEGSNKYYADSVK GRFTISRDNSKNTLYLQMNSLRAEDTAVYYCARELGDGMDVWGQGTTVTVSSGGGGSGGGGSGGG GSGGGGSEIVLTQSPATLSLSPGERATLSCRASQSVSSSYLAWFQQKPGQAPRLLIYDASNRATGI PARFSGSGSGTDFTLTISSLEPEDFAVYYCQQRVDLWTFGGGTKVEIKTTTPAPRPPTPAPTIAS QPLSLRPEACRPAAGGAVHTRGLDFACDFWVLVVVGGVLACYSLLVTVAFIIFWVTKKKYSSSVH DPNGEYMFMRAVNTAKKSRLTDVTLRVKFSRSADAPAYQQGQNQLYNELNLGRREEYDVLDKRRG RDPEMGGKPRRKNPQEGLYNELQKDKMAEAYSEIGMKGERRRGKGHDGLYQGLSTATKDTYDALH MQALPPR |
| 267 | QVQLVESGGGVVQPGRSLRLSCAASGFTFSSYGMHWVRQAPGKGLEWVAVISYEGSNKYYADSVK GRFTISRDNSKNTLYLQMNSLRAEDTAVYYCARELGDGMDVWGQGTTVTVSSGGGGSGGGGSGGG GSGGGGSEIVLTQSPATLSLSPGERATLSCRASQSVSSSYLAWFQQKPGQAPRLLIYDASNRATGI PARFSGSGSGTDFTLTISSLEPEDFAVYYCQQRVDLWTFGGGTKVEIKIEVMYPPPYLDNEKSNG TIIHVKGKHLCPSPLFPGPSKPIYIWAPLAGTCGVLLLSLVITLYCKRGRKKLLYIFKQPFMRPV QTTQEEDGCSCRFPEEEEGGCELRVKFSRSADAPAYQQGQNQLYNELNLGRREEYDVLDKRRGRD PEMGGKPRRKNPQEGLYNELQKDKMAEAYSEIGMKGERRRGKGHDGLYQGLSTATKDTYDALHMQ ALPPR |
| 268 | QVQLVESGGGVVQPGRSLRLSCAASGFTFSSYGMHWVRQAPGKGLEWVAVISYEGSNKYYADSVK GRFTISRDNSKNTLYLQMNSLRAEDTAVYYCARELGDGMDVWGQGTTVTVSSGGGGSGGGGSGGG GSGGGGSEIVLTQSPATLSLSPGERATLSCRASQSVSSSYLAWFQQKPGQAPRLLIYDASNRATGI PARFSGSGSGTDFTLTISSLEPEDFAVYYCQQRVDLWTFGGGTKVEIKIEVMYPPPYLDNEKSNG TIIHVKGKHLCPSPLFPGPSKPIYIWAPLAGTCGVLLLSLVITLYCRSKRSRLLHSDYMNMTPRR PGPTRKHYQPYAPPRDFAAYRSRVKFSRSADAPAYQQGQNQLYNELNLGRREEYDVLDKRRGRDP EMGGKPRRKNPQEGLYNELQKDKMAEAYSEIGMKGERRRGKGHDGLYQGLSTATKDTYDALHMQA LPPR |
| 269 | QVQLVESGGGVVQPGRSLRLSCAASGFTFSSYGMHWVRQAPGKGLEWVAVISYEGSNKYYADSVK GRFTISRDNSKNTLYLQMNSLRAEDTAVYYCARELGDGMDVWGQGTTVTVSSGGGGSGGGGSGGG GSGGGGSEIVLTQSPATLSLSPGERATLSCRASQSVSSSYLAWFQQKPGQAPRLLIYDASNRATGI PARFSGSGSGTDFTLTISSLEPEDFAVYYCQQRVDLWTFGGGTKVEIKIEVMYPPPYLDNEKSNG TIIHVKGKHLCPSPLFPGPSKPIYIWAPLAGTCGVLLLSLVITLYCTKKKYSSSVHDPNGEYMFM RAVNTAKKSRLTDVTLRVKFSRSADAPAYQQGQNQLYNELNLGRREEYDVLDKRRGRDPEMGGKP RRKNPQEGLYNELQKDKMAEAYSEIGMKGERRRGKGHDGLYQGLSTATKDTYDALHMQALPPR |
| 270 | QVQLVESGGGVVQPGRSLRLSCAASGFTFSSYGMHWVRQAPGKGLEWVAVISYEGSNKYYADSVK GRFTISRDNSKNTLYLQMNSLRAEDTAVYYCARELGDGMDVWGQGTTVTVSSGGGGSGGGGSGGG GSGGGGSEIVLTQSPATLSLSPGERATLSCRASQSVSSSYLAWFQQKPGQAPRLLIYDASNRATGI PARFSGSGSGTDFTLTISSLEPEDFAVYYCQQRVDLWTFGGGTKVEIKIEVMYPPPYLDNEKSNG TIIHVKGKHLCPSPLFPGPSKPFWVLVVVGGVLACYSLLVTVAFIIFWVKRGRKKLLYIFKQPFM RPVQTTQEEDGCSCRFPEEEEGGCELRVKFSRSADAPAYQQGQNQLYNELNLGRREEYDVLDKRR GRDPEMGGKPRRKNPQEGLYNELQKDKMAEAYSEIGMKGERRRGKGHDGLYQGLSTATKDTYDAL HMQALPPR |

-continued

| SEQ ID NO. | AMINO ACID SEQUENCE |
|---|---|
| 271 | QVQLVESGGGVVQPGRSLRLSCAASGFTFSSYGMHWVRQAPGKGLEWVAVISYEGSNKYYADSVK<br>GRFTISRDNSKNTLYLQMNSLRAEDTAVYYCARELGDGMDVWGQGTTVTVSSGGGGSGGGGSGGG<br>GSGGGGSEIVLTQSPATLSLSPGERATLSCRASQSVSSYLAWFQQKPGQAPRLLIYDASNRATGI<br>PARFSGSGSGTDFTLTISSLEPEDFAVYYCQQRVDLWTFGGGTKVEIKIEVMYPPPYLDNEKSNG<br>TIIHVKGKHLCPSPLFPGPSKPFWVLVVVGGVLACYSLLVTVAFIIFWVRSKRSRLLHSDYMNMT<br>PRRPGPTRKHYQPYAPPRDFAAYRSRVKFSRSADAPAYQQGQNQLYNELNLGRREEYDVLDKRRG<br>RDPEMGGKPRRKNPQEGLYNELQKDKMAEAYSEIGMKGERRRGKGHDGLYQGLSTATKDTYDALH<br>MQALPPR |
| 272 | QVQLVESGGGVVQPGRSLRLSCAASGFTFSSYGMHWVRQAPGKGLEWVAVISYEGSNKYYADSVK<br>GRFTISRDNSKNTLYLQMNSLRAEDTAVYYCARELGDGMDVWGQGTTVTVSSGGGGSGGGGSGGG<br>GSGGGGSEIVLTQSPATLSLSPGERATLSCRASQSVSSYLAWFQQKPGQAPRLLIYDASNRATGI<br>PARFSGSGSGTDFTLTISSLEPEDFAVYYCQQRVDLWTFGGGTKVEIKIEVMYPPPYLDNEKSNG<br>TIIHVKGKHLCPSPLFPGPSKPFWVLVVVGGVLACYSLLVTVAFIIFWVTKKKYSSSVHDPNGEY<br>MFMRAVNTAKKSRLTDVTLRVKFSRSADAPAYQQGQNQLYNELNLGRREEYDVLDKRRGRDPEMG<br>GKPRRKNPQEGLYNELQKDKMAEAYSEIGMKGERRRGKGHDGLYQGLSTATKDTYDALHMQALPP<br>R |
| 273 | QVQLVESGGGVVQPGRSLRLSCAASGFTFSSYGMHWVRQAPGKGLEWVAVISYEGSNKYYADSVK<br>GRFTISRDNSKNTLYLQMNSLRAEDTAVYYCARELGDGMDVWGQGTTVTVSSGGGGSGGGGSGGG<br>GSGGGGSEIVLTQSPATLSLSPGERATLSCRASQSVSSYLAWFQQKPGQAPRLLIYDASNRATGI<br>PARFSGSGSGTDFTLTISSLEPEDFAVYYCQQRVDLWTFGGGTKVEIKESKYGPPCPPCPIYIWA<br>PLAGTCGVLLLSLVITLYCKRGRKKLLYIFKQPFMRPVQTTQEEDGCSCRFPEEEEGGCELRVKE<br>SRSADAPAYQQGQNQLYNELNLGRREEYDVLDKRRGRDPEMGGKPRRKNPQEGLYNELQKDKMAE<br>AYSEIGMKGERRRGKGHDGLYQGLSTATKDTYDALHMQALPPR |
| 274 | QVQLVESGGGVVQPGRSLRLSCAASGFTFSSYGMHWVRQAPGKGLEWVAVISYEGSNKYYADSVK<br>GRFTISRDNSKNTLYLQMNSLRAEDTAVYYCARELGDGMDVWGQGTTVTVSSGGGGSGGGGSGGG<br>GSGGGGSEIVLTQSPATLSLSPGERATLSCRASQSVSSYLAWFQQKPGQAPRLLIYDASNRATGI<br>PARFSGSGSGTDFTLTISSLEPEDFAVYYCQQRVDLWTFGGGTKVEIKESKYGPPCPPCPIYIWA<br>PLAGTCGVLLLSLVITLYCRSKRSRLLHSDYMNMTPRRPGPTRKHYQPYAPPRDFAAYRSRVKES<br>RSADAPAYQQGQNQLYNELNLGRREEYDVLDKRRGRDPEMGGKPRRKNPQEGLYNELQKDKMAEA<br>YSEIGMKGERRRGKGHDGLYQGLSTATKDTYDALHMQALPPR |
| 275 | QVQLVESGGGVVQPGRSLRLSCAASGFTFSSYGMHWVRQAPGKGLEWVAVISYEGSNKYYADSVK<br>GRFTISRDNSKNTLYLQMNSLRAEDTAVYYCARELGDGMDVWGQGTTVTVSSGGGGSGGGGSGGG<br>GSGGGGSEIVLTQSPATLSLSPGERATLSCRASQSVSSYLAWFQQKPGQAPRLLIYDASNRATGI<br>PARFSGSGSGTDFTLTISSLEPEDFAVYYCQQRVDLWTFGGGTKVEIKESKYGPPCPPCPIYIWA<br>PLAGTCGVLLLSLVITLYCTKKKYSSSVHDPNGEYMFMRAVNTAKKSRLTDVTLRVKFSRSADAP<br>AYQQGQNQLYNELNLGRREEYDVLDKRRGRDPEMGGKPRRKNPQEGLYNELQKDKMAEAYSEIGM<br>KGERRRGKGHDGLYQGLSTATKDTYDALHMQALPPR |
| 276 | QVQLVESGGGVVQPGRSLRLSCAASGFTFSSYGMHWVRQAPGKGLEWVAVISYEGSNKYYADSVK<br>GRFTISRDNSKNTLYLQMNSLRAEDTAVYYCARELGDGMDVWGQGTTVTVSSGGGGSGGGGSGGG<br>GSGGGGSEIVLTQSPATLSLSPGERATLSCRASQSVSSYLAWFQQKPGQAPRLLIYDASNRATGI<br>PARFSGSGSGTDFTLTISSLEPEDFAVYYCQQRVDLWTFGGGTKVEIKESKYGPPCPPCPFWVLV<br>VVGGVLACYSLLVTVAFIIFWVKRGRKKLLYIFKQPEMRPVQTTQEEDGCSCRFPEEEEGGCELR<br>VKFSRSADAPAYQQGQNQLYNELNLGRREEYDVLDKRRGRDPEMGGKPRRKNPQEGLYNELQKDK<br>MAEAYSEIGMKGERRRGKGHDGLYQGLSTATKDTYDALHMQALPPR |
| 277 | QVQLVESGGGVVQPGRSLRLSCAASGFTFSSYGMHWVRQAPGKGLEWVAVISYEGSNKYYADSVK<br>GRFTISRDNSKNTLYLQMNSLRAEDTAVYYCARELGDGMDVWGQGTTVTVSSGGGGSGGGGSGGG<br>GSGGGGSEIVLTQSPATLSLSPGERATLSCRASQSVSSYLAWFQQKPGQAPRLLIYDASNRATGI<br>PARFSGSGSGTDFTLTISSLEPEDFAVYYCQQRVDLWTFGGGTKVEIKESKYGPPCPPCPFWVLV<br>VVGGVLACYSLLVTVAFIIFWVRSKRSRLLHSDYMNMTPRRPGPTRKHYQPYAPPRDFAAYRSRV<br>KFSRSADAPAYQQGQNQLYNELNLGRREEYDVLDKRRGRDPEMGGKPRRKNPQEGLYNELQKDKM<br>AEAYSEIGMKGERRRGKGHDGLYQGLSTATKDTYDALHMQALPPR |
| 278 | QVQLVESGGGVVQPGRSLRLSCAASGFTFSSYGMHWVRQAPGKGLEWVAVISYEGSNKYYADSVK<br>GRFTISRDNSKNTLYLQMNSLRAEDTAVYYCARELGDGMDVWGQGTTVTVSSGGGGSGGGGSGGG<br>GSGGGGSEIVLTQSPATLSLSPGERATLSCRASQSVSSYLAWFQQKPGQAPRLLIYDASNRATGI<br>PARFSGSGSGTDFTLTISSLEPEDFAVYYCQQRVDLWTFGGGTKVEIKESKYGPPCPPCPFWVLV<br>VVGGVLACYSLLVTVAFIIFWVTKKKYSSSVHDPNGEYMFMRAVNTAKKSRLTDVTLRVKFSRSA<br>DAPAYQQGQNQLYNELNLGRREEYDVLDKRRGRDPEMGGKPRRKNPQEGLYNELQKDKMAEAYSE<br>IGMKGERRRGKGHDGLYQGLSTATKDTYDALHMQALPPR |
| 279 | QVQLVESGGGVVQPGRSLRLSCAASGFTFSSYGMHWVRQAPGKGLEWVAVISYEGSNKYYADSVK<br>GRFTISRDNSKNTLYLQMNSLRAEDTAVYYCARELGDGMDVWGQGTTVTVSSGGGGSGGGGSGGG<br>GSGGGGSEIVLTQSPATLSLSPGERATLSCRASQSVSSYLAWFQQKPGQAPRLLIYDASNRATGI<br>PARFSGSGSGTDFTLTISSLEPEDFAVYYCQQRVDLWTFGGGTKVEIKLEPKSCDKTHTCPPCPI<br>YIWAPLAGTCGVLLLSLVITLYCKRGRKKLLYIFKQPEMRPVQTTQEEDGCSCRFPEEEEGGCEL<br>RVKFSRSADAPAYQQGQNQLYNELNLGRREEYDVLDKRRGRDPEMGGKPRRKNPQEGLYNELQKD<br>KMAEAYSEIGMKGERRRGKGHDGLYQGLSTATKDTYDALHMQALPPR |

-continued

| SEQ ID NO. | AMINO ACID SEQUENCE |
|---|---|
| 280 | QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSGGGGSGGGGSGGGGSGGGGSEIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKLEPKSCDKTHTCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 281 | QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSGGGGSGGGGSGGGGSGGGGSEIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKLEPKSCDKTHTCPPCPIYIWAPLAGTCGVLLLSLVITLYCTKKKYSSSVHDPNGEYMFMRAVNTAKKSRLIDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 282 | QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSGGGGSGGGGSGGGGSGGGGSEIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKLEPKSCDKTHTCPPCPFWVLVVVGGVLACYSLLVTVAFIIFWVKRGRKKLLYIFKQPEMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 283 | QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSGGGGSGGGGSGGGGSGGGGSEIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKLEPKSCDKTHTCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 284 | QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSGGGGSGGGGSGGGGSGGGGSEIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKLEPKSCDKTHTCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |

In particular embodiments, a CAR comprises an antibody or antigen binding fragment thereof comprising an amino acid sequence set forth in SEQ ID NO: 40; a spacer domain comprising an amino acid sequence set forth in SEQ ID NO: 145, SEQ ID NO: 146, SEQ ID NO: 148, or SEQ ID NO: 150; a transmembrane domain comprising an amino acid sequence set forth in SEQ ID NO: 151 or SEQ ID NO: 153; a costimulatory domain comprising an amino acid sequence set forth in SEQ ID NO: 159, SEQ ID NO: 160, or SEQ ID NO: 162; and a primary signaling domain comprising an amino acid sequence set forth in SEQ ID NO: 158. In particular embodiments, a CAR comprises an amino acid sequence set forth in any one of SEQ ID NOs: 285, 286, 287, 288, 289, 290, 291, 292, 293, 294, 295, 296, 297, 298, 299, 300, 301, 302, 303, 304, 305, 306, 307, and 308.

| SEQ ID NO. | AMINO ACID SEQUENCE |
|---|---|
| 285 | EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 286 | EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |

-continued

| SEQ ID NO. | AMINO ACID SEQUENCE |
|---|---|
| 287 | EIVLTQSPATLSLSPGERATLSCRASQSVSSYLAWFQQKPGQAPRLLIYDASNRATGIPARFSGS GSGTDFTLTISSLEPEDFAVYYCQQRVDLWTFGGGTKVEIKGGGGSGGGGSGGGGSGGGGSQVQL VESGGGVVQPGRSLRLSCAASGFTFSSYGMHWVRQAPGKGLEWVAVISYEGSNKYYADSVKGRFT ISRDNSKNTLYLQMNSLRAEDTAVYYCARELGDGMDVWGQGTTVTVSSTTTPAPRPPTPAPTIAS QPLSLRPEACRPAAGGAVHTRGLDFACDIYIWAPLAGTCGVLLLSLVITLYCTKKKYSSSVHDPN GEYMFMRAVNTAKKSRLTDVTLRVKFSRSADAPAYQQGQNQLYNELNLGRREEYDVLDKRRGRDP EMGGKPRRKNPQEGLYNELQKDKMAEAYSEIGMKGERRRGKGHDGLYQGLSTATKDTYDALHMQA LPPR |
| 288 | EIVLTQSPATLSLSPGERATLSCRASQSVSSYLAWFQQKPGQAPRLLIYDASNRATGIPARFSGS GSGTDFTLTISSLEPEDFAVYYCQQRVDLWTFGGGTKVEIKGGGGSGGGGSGGGGSGGGGSQVQL VESGGGVVQPGRSLRLSCAASGFTFSSYGMHWVRQAPGKGLEWVAVISYEGSNKYYADSVKGRFT ISRDNSKNTLYLQMNSLRAEDTAVYYCARELGDGMDVWGQGTTVTVSSTTTPAPRPPTPAPTIAS QPLSLRPEACRPAAGGAVHTRGLDFACDFWVLVVVGGVLACYSLLVTVAFIIFWVKRGRKKLLYI FKQPFMRPVQTTQEEDGCSCRFPEEEEGGCELRVKESRSADAPAYQQGQNQLYNELNLGRREEYD VLDKRRGRDPEMGGKPRRKNPQEGLYNELQKDKMAEAYSEIGMKGERRRGKGHDGLYQGLSTATK DTYDALHMQALPPR |
| 289 | EIVLTQSPATLSLSPGERATLSCRASQSVSSYLAWFQQKPGQAPRLLIYDASNRATGIPARFSGS GSGTDFTLTISSLEPEDFAVYYCQQRVDLWTFGGGTKVEIKGGGGSGGGGSGGGGSGGGGSQVQL VESGGGVVQPGRSLRLSCAASGFTFSSYGMHWVRQAPGKGLEWVAVISYEGSNKYYADSVKGRFT ISRDNSKNTLYLQMNSLRAEDTAVYYCARELGDGMDVWGQGTTVTVSSTTTPAPRPPTPAPTIAS QPLSLRPEACRPAAGGAVHTRGLDFACDFWVLVVVGGVLACYSLLVTVAFIIFWVRSKRSRLLHS DYMNMTPRRPGPTRKHYQPYAPPRDFAAYRSRVKFSRSADAPAYQQGQNQLYNELNLGRREEYDV LDKRRGRDPEMGGKPRRKNPQEGLYNELQKDKMAEAYSEIGMKGERRRGKGHDGLYQGLSTATKD TYDALHMQALPPR |
| 290 | EIVLTQSPATLSLSPGERATLSCRASQSVSSYLAWFQQKPGQAPRLLIYDASNRATGIPARFSGS GSGTDFTLTISSLEPEDFAVYYCQQRVDLWTFGGGTKVEIKGGGGSGGGGSGGGGSGGGGSQVQL VESGGGVVQPGRSLRLSCAASGFTFSSYGMHWVRQAPGKGLEWVAVISYEGSNKYYADSVKGRFT ISRDNSKNTLYLQMNSLRAEDTAVYYCARELGDGMDVWGQGTTVTVSSTTTPAPRPPTPAPTIAS QPLSLRPEACRPAAGGAVHTRGLDFACDFWVLVVVGGVLACYSLLVTVAFIIFWVTKKKYSSSVH DPNGEYMFMRAVNTAKKSRLTDVTLRVKFSRSADAPAYQQGQNQLYNELNLGRREEYDVLDKRRG RDPEMGGKPRRKNPQEGLYNELQKDKMAEAYSEIGMKGERRRGKGHDGLYQGLSTATKDTYDALH MQALPPR |
| 291 | EIVLTQSPATLSLSPGERATLSCRASQSVSSYLAWFQQKPGQAPRLLIYDASNRATGIPARFSGS GSGTDFTLTISSLEPEDFAVYYCQQRVDLWTFGGGTKVEIKGGGGSGGGGSGGGGSGGGGSQVQL VESGGGVVQPGRSLRLSCAASGFTFSSYGMHWVRQAPGKGLEWVAVISYEGSNKYYADSVKGRFT ISRDNSKNTLYLQMNSLRAEDTAVYYCARELGDGMDVWGQGTTVTVSSIEVMYPPPYLDNEKSNG TIIHVKGKHLCPSPLFPGPSKPIYIWAPLAGTCGVLLLSLVITLYCKRGRKKLLYIFKQPFMRPV QTTQEEDGCSCRFPEEEEGGCELRVKFSRSADAPAYQQGQNQLYNELNLGRREEYDVLDKRRGRD PEMGGKPRRKNPQEGLYNELQKDKMAEAYSEIGMKGERRRGKGHDGLYQGLSTATKDTYDALHMQ ALPPR |
| 292 | EIVLTQSPATLSLSPGERATLSCRASQSVSSYLAWFQQKPGQAPRLLIYDASNRATGIPARFSGS GSGTDFTLTISSLEPEDFAVYYCQQRVDLWTFGGGTKVEIKGGGGSGGGGSGGGGSGGGGSQVQL VESGGGVVQPGRSLRLSCAASGFTFSSYGMHWVRQAPGKGLEWVAVISYEGSNKYYADSVKGRFT ISRDNSKNTLYLQMNSLRAEDTAVYYCARELGDGMDVWGQGTTVTVSSIEVMYPPPYLDNEKSNG TIIHVKGKHLCPSPLFPGPSKPIYIWAPLAGTCGVLLLSLVITLYCRSKRSRLLHSDYMNMTPRR PGPTRKHYQPYAPPRDFAAYRSRVKFSRSADAPAYQQGQNQLYNELNLGRREEYDVLDKRRGRDP EMGGKPRRKNPQEGLYNELQKDKMAEAYSEIGMKGERRRGKGHDGLYQGLSTATKDTYDALHMQA LPPR |
| 293 | EIVLTQSPATLSLSPGERATLSCRASQSVSSYLAWFQQKPGQAPRLLIYDASNRATGIPARFSGS GSGTDFTLTISSLEPEDFAVYYCQQRVDLWTFGGGTKVEIKGGGGSGGGGSGGGGSGGGGSQVQL VESGGGVVQPGRSLRLSCAASGFTFSSYGMHWVRQAPGKGLEWVAVISYEGSNKYYADSVKGRFT ISRDNSKNTLYLQMNSLRAEDTAVYYCARELGDGMDVWGQGTTVTVSSIEVMYPPPYLDNEKSNG TIIHVKGKHLCPSPLFPGPSKPIYIWAPLAGTCGVLLLSLVITLYCTKKKYSSSVHDPNGEYMFM RAVNTAKKSRLTDVTLRVKFSRSADAPAYQQGQNQLYNELNLGRREEYDVLDKRRGRDPEMGGKP RRKNPQEGLYNELQKDKMAEAYSEIGMKGERRRGKGHDGLYQGLSTATKDTYDALHMQALPPR |
| 294 | EIVLTQSPATLSLSPGERATLSCRASQSVSSYLAWFQQKPGQAPRLLIYDASNRATGIPARFSGS GSGTDFTLTISSLEPEDFAVYYCQQRVDLWTFGGGTKVEIKGGGGSGGGGSGGGGSGGGGSQVQL VESGGGVVQPGRSLRLSCAASGFTFSSYGMHWVRQAPGKGLEWVAVISYEGSNKYYADSVKGRFT ISRDNSKNTLYLQMNSLRAEDTAVYYCARELGDGMDVWGQGTTVTVSSIEVMYPPPYLDNEKSNG TIIHVKGKHLCPSPLFPGPSKPFWVLVVVGGVLACYSLLVTVAFIIFWVKRGRKKLLYIFKQPFM RPVQTTQEEDGCSCRFPEEEEGGCELRVKFSRSADAPAYQQGQNQLYNELNLGRREEYDVLDKRR GRDPEMGGKPRRKNPQEGLYNELQKDKMAEAYSEIGMKGERRRGKGHDGLYQGLSTATKDTYDAL HMQALPPR |
| 295 | EIVLTQSPATLSLSPGERATLSCRASQSVSSYLAWFQQKPGQAPRLLIYDASNRATGIPARFSGS GSGTDFTLTISSLEPEDFAVYYCQQRVDLWTFGGGTKVEIKGGGGSGGGGSGGGGSGGGGSQVQL VESGGGVVQPGRSLRLSCAASGFTFSSYGMHWVRQAPGKGLEWVAVISYEGSNKYYADSVKGRFT ISRDNSKNTLYLQMNSLRAEDTAVYYCARELGDGMDVWGQGTTVTVSSIEVMYPPPYLDNEKSNG |

-continued

| SEQ ID NO. | AMINO ACID SEQUENCE |
|---|---|
| | TIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 296 | EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 297 | EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 298 | EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 299 | EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 300 | EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 301 | EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSESKYGPPCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 302 | EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSESKYGPPCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 303 | EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 304 | EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSLEPKSCDKTHTCPPCPIYIWAPLAGTCGVLLLSLVITLYCRSKRSRLLHSDYMNMTPRRPGPTRKHYQPYAPPRDFAAYRSR |

-continued

| SEQ ID NO. | AMINO ACID SEQUENCE |
|---|---|
| | VKFSRSADAPAYQQGQNQLYNELNLGRREEYDVLDKRRGRDPEMGGKPRRKNPQEGLYNELQKDK MAEAYSEIGMKGERRRGKGHDGLYQGLSTATKDTYDALHMQALPPR |
| 305 | EIVLTQSPATLSLSPGERATLSCRASQSVSSYLAWFQQKPGQAPRLLIYDASNRATGIPARFSGS GSGTDFTLTISSLEPEDFAVYYCQQRVDLWTFGGGTKVEIKGGGGSGGGGSGGGGSGGGGSQVQL VESGGGVVQPGRSLRLSCAASGFTFSSYGMHWVRQAPGKGLEWVAVISYEGSNKYYADSVKGRFT ISRDNSKNTLYLQMNSLRAEDTAVYYCARELGDGMDVWGQGTTVTVSSLEPKSCDKTHTCPPCPI YIWAPLAGTCGVLLLSLVITLYCTKKKYSSSVHDPNGEYMFMRAVNTAKKSRLTDVTLRVKFSRS ADAPAYQQGQNQLYNELNLGRREEYDVLDKRRGRDPEMGGKPRRKNPQEGLYNELQKDKMAEAYS EIGMKGERRRGKGHDGLYQGLSTATKDTYDALHMQALPPR |
| 306 | EIVLTQSPATLSLSPGERATLSCRASQSVSSYLAWFQQKPGQAPRLLIYDASNRATGIPARFSGS GSGTDFTLTISSLEPEDFAVYYCQQRVDLWTFGGGTKVEIKGGGGSGGGGSGGGGSGGGGSQVQL VESGGGVVQPGRSLRLSCAASGFTFSSYGMHWVRQAPGKGLEWVAVISYEGSNKYYADSVKGRFT ISRDNSKNTLYLQMNSLRAEDTAVYYCARELGDGMDVWGQGTTVTVSSLEPKSCDKTHTCPPCPF WVLVVVGGVLACYSLLVTVAFIIFWVKRGRKKLLYIFKQPFMRPVQTTQEEDGCSCRFPEEEEGG CELRVKFSRSADAPAYQQGQNQLYNELNLGRREEYDVLDKRRGRDPEMGGKPRRKNPQEGLYNEL QKDKMAEAYSEIGMKGERRRGKGHDGLYQGLSTATKDTYDALHMQALPPR |
| 307 | EIVLTQSPATLSLSPGERATLSCRASQSVSSYLAWFQQKPGQAPRLLIYDASNRATGIPARFSGS GSGTDFTLTISSLEPEDFAVYYCQQRVDLWTFGGGTKVEIKGGGGSGGGGSGGGGSGGGGSQVQL VESGGGVVQPGRSLRLSCAASGFTFSSYGMHWVRQAPGKGLEWVAVISYEGSNKYYADSVKGRFT ISRDNSKNTLYLQMNSLRAEDTAVYYCARELGDGMDVWGQGTTVTVSSLEPKSCDKTHTCPPCPF WVLVVVGGVLACYSLLVTVAFIIFWVRSKRSRLLHSDYMNMTPRRPGPTRKHYQPYAPPRDFAAY RSRVKFSRSADAPAYQQGQNQLYNELNLGRREEYDVLDKRRGRDPEMGGKPRRKNPQEGLYNELQ KDKMAEAYSEIGMKGERRRGKGHDGLYQGLSTATKDTYDALHMQALPPR |
| 308 | EIVLTQSPATLSLSPGERATLSCRASQSVSSYLAWFQQKPGQAPRLLIYDASNRATGIPARFSGS GSGTDFTLTISSLEPEDFAVYYCQQRVDLWTFGGGTKVEIKGGGGSGGGGSGGGGSGGGGSQVQL VESGGGVVQPGRSLRLSCAASGFTFSSYGMHWVRQAPGKGLEWVAVISYEGSNKYYADSVKGRFT ISRDNSKNTLYLQMNSLRAEDTAVYYCARELGDGMDVWGQGTTVTVSSLEPKSCDKTHTCPPCPF WVLVVVGGVLACYSLLVTVAFIIFWVTKKKYSSSVHDPNGEYMFMRAVNTAKKSRLTDVTLRVKF SRSADAPAYQQGQNQLYNELNLGRREEYDVLDKRRGRDPEMGGKPRRKNPQEGLYNELQKDKMAE AYSEIGMKGERRRGKGHDGLYQGLSTATKDTYDALHMQALPPR |

In particular embodiments, a CAR comprises an antibody or antigen binding fragment thereof comprising an amino acid sequence set forth in SEQ ID NO: 49 or SEQ ID NO: 50; a spacer domain comprising an amino acid sequence set forth in SEQ ID NO: 145, SEQ ID NO: 146, SEQ ID NO: 148, or SEQ ID NO: 150; a transmembrane domain comprising an amino acid sequence set forth in SEQ ID NO: 151 or SEQ ID NO: 153; a costimulatory domain comprising an amino acid sequence set forth in SEQ ID NO: 159, SEQ ID NO: 160, or SEQ ID NO: 162; and a primary signaling domain comprising an amino acid sequence set forth in SEQ ID NO: 158. In particular embodiments, a CAR comprises an amino acid sequence set forth in any one of SEQ ID NOs: 309, 310, 311, 312, 313, 314, 315, 316, 317, 318, 319, 320, 321, 322, 323, 324, 325, 326, 327, 328, 329, 330, 331, and 332. In particular embodiments, a CAR comprises an amino acid sequence set forth in any one of SEQ ID NOs: 333, 334, 335, 336, 337, 338, 339, 340, 341, 342, 343, 344, 345, 346, 347, 348, 349, 350, 351, 352, 353, 354, 355, and 356.

| SEQ ID NO. | AMINO ACID SEQUENCE |
|---|---|
| 309 | EVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYDASSLESG VPSRFSGSGSGTEFTLTISSLQPDDFATYYCQQVSSLPPTFGGGTKVEIKTTTPAPRPPTPAPTI ASQPLSLRPEACRPAAGGAVHTRGLDFACDIYIWAPLAGTCGVLLLSLVITLYCKRGRKKLLYIF KQPFMRPVQTTQEEDGCSCRFPEEEEGGCELRVKFSRSADAPAYQQGQNQLYNELNLGRREEYDV LDKRRGRDPEMGGKPRRKNPQEGLYNELQKDKMAEAYSEIGMKGERRRGKGHDGLYQGLSTATKD TYDALHMQALPPR |
| 310 | EVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYDASSLESG VPSRFSGSGSGTEFTLTISSLQPDDFATYYCQQVSSLPPTFGGGTKVEIKTTTPAPRPPTPAPTI ASQPLSLRPEACRPAAGGAVHTRGLDFACDIYIWAPLAGTCGVLLLSLVITLYCRSKRSRLLHSD YMNMTPRRPGPTRKHYQPYAPPRDFAAYRSRVKFSRSADAPAYQQGQNQLYNELNLGRREEYDVL DKRRGRDPEMGGKPRRKNPQEGLYNELQKDKMAEAYSEIGMKGERRRGKGHDGLYQGLSTATKDT YDALHMQALPPR |
| 311 | EVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG |

-continued

| SEQ ID NO. | AMINO ACID SEQUENCE |
|---|---|
| | GGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 312 | EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 313 | EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 314 | EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 315 | EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 316 | EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 317 | EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 318 | EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 319 | EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKR |

-continued

| SEQ ID NO. | AMINO ACID SEQUENCE |
|---|---|
| | RGRDPEMGGKPRRKNPQEGLYNELQKDKMAEAYSEIGMKGERRRGKGHDGLYQGLSTATKDTYDA LHMQALPPR |
| 320 | EVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYDASSLESG VPSRFSGSGSGTEFTLTISSLQPDDFATYYCQQVSSLPPTFGGGTKVEIKIEVMYPPPYLDNEKS NGTIIHVKGKHLCPSPLFPGPSKPFWVLVVVGGVLACYSLLVTVAFIIFWVTKKKYSSSVHDPNG EYMFMRAVNTAKKSRLTDVTLRVKFSRSADAPAYQQGQNQLYNELNLGRREEYDVLDKRRGRDPE MGGKPRRKNPQEGLYNELQKDKMAEAYSEIGMKGERRRGKGHDGLYQGLSTATKDTYDALHMQAL PPR |
| 321 | EVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYDASSLESG VPSRFSGSGSGTEFTLTISSLQPDDFATYYCQQVSSLPPTFGGGTKVEIKESKYGPPCPPCPIYI WAPLAGTCGVLLLSLVITLYCKRGRKKLLYIFKQPFMRPVQTTQEEDGCSCRFPEEEEGGCELRV KFSRSADAPAYQQGQNQLYNELNLGRREEYDVLDKRRGRDPEMGGKPRRKNPQEGLYNELQKDKM AEAYSEIGMKGERRRGKGHDGLYQGLSTATKDTYDALHMQALPPR |
| 322 | EVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYDASSLESG VPSRFSGSGSGTEFTLTISSLQPDDFATYYCQQVSSLPPTFGGGTKVEIKESKYGPPCPPCPIYI WAPLAGTCGVLLLSLVITLYCRSKRSRLLHSDYMNMTPRRPGPTRKHYQPYAPPRDFAAYRSRVK FSRSADAPAYQQGQNQLYNELNLGRREEYDVLDKRRGRDPEMGGKPRRKNPQEGLYNELQKDKMA EAYSEIGMKGERRRGKGHDGLYQGLSTATKDTYDALHMQALPPR |
| 323 | EVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYDASSLESG VPSRFSGSGSGTEFTLTISSLQPDDFATYYCQQVSSLPPTFGGGTKVEIKESKYGPPCPPCPIYI WAPLAGTCGVLLLSLVITLYCTKKKYSSSVHDPNGEYMFMRAVNTAKKSRLTDVTLRVKFSRSAD APAYQQGQNQLYNELNLGRREEYDVLDKRRGRDPEMGGKPRRKNPQEGLYNELQKDKMAEAYSEI GMKGERRRGKGHDGLYQGLSTATKDTYDALHMQALPPR |
| 324 | EVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYDASSLESG VPSRFSGSGSGTEFTLTISSLQPDDFATYYCQQVSSLPPTFGGGTKVEIKESKYGPPCPPCPFWV LVVVGGVLACYSLLVTVAFIIFWVKRGRKKLLYIFKQPFMRPVQTTQEEDGCSCRFPEEEEGGCE LRVKFSRSADAPAYQQGQNQLYNELNLGRREEYDVLDKRRGRDPEMGGKPRRKNPQEGLYNELQK DKMAEAYSEIGMKGERRRGKGHDGLYQGLSTATKDTYDALHMQALPPR |
| 325 | EVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYDASSLESG VPSRFSGSGSGTEFTLTISSLQPDDFATYYCQQVSSLPPTFGGGTKVEIKESKYGPPCPPCPFWV LVVVGGVLACYSLLVTVAFIIFWVRSKRSRLLHSDYMNMTPRRPGPTRKHYQPYAPPRDFAAYRS RVKFSRSADAPAYQQGQNQLYNELNLGRREEYDVLDKRRGRDPEMGGKPRRKNPQEGLYNELQKD KMAEAYSEIGMKGERRRGKGHDGLYQGLSTATKDTYDALHMQALPPR |
| 326 | EVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYDASSLESG VPSRFSGSGSGTEFTLTISSLQPDDFATYYCQQVSSLPPTFGGGTKVEIKESKYGPPCPPCPFWV LVVVGGVLACYSLLVTVAFIIFWVTKKKYSSSVHDPNGEYMFMRAVNTAKKSRLTDVTLRVKFSR SADAPAYQQGQNQLYNELNLGRREEYDVLDKRRGRDPEMGGKPRRKNPQEGLYNELQKDKMAEAY SEIGMKGERRRGKGHDGLYQGLSTATKDTYDALHMQALPPR |
| 327 | EVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYDASSLESG VPSRFSGSGSGTEFTLTISSLQPDDFATYYCQQVSSLPPTFGGGTKVEIKLEPKSCDKTHTCPPC PIYIWAPLAGTCGVLLLSLVITLYCKRGRKKLLYIFKQPFMRPVQTTQEEDGCSCRFPEEEEGGC ELRVKFSRSADAPAYQQGQNQLYNELNLGRREEYDVLDKRRGRDPEMGGKPRRKNPQEGLYNELQ KDKMAEAYSEIGMKGERRRGKGHDGLYQGLSTATKDTYDALHMQALPPR |
| 328 | EVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYDASSLESG VPSRFSGSGSGTEFTLTISSLQPDDFATYYCQQVSSLPPTFGGGTKVEIKLEPKSCDKTHTCPPC PIYIWAPLAGTCGVLLLSLVITLYCRSKRSRLLHSDYMNMTPRRPGPTRKHYQPYAPPRDFAAYR SRVKFSRSADAPAYQQGQNQLYNELNLGRREEYDVLDKRRGRDPEMGGKPRRKNPQEGLYNELQK DKMAEAYSEIGMKGERRRGKGHDGLYQGLSTATKDTYDALHMQALPPR |

-continued

| SEQ ID NO. | AMINO ACID SEQUENCE |
|---|---|
| 329 | EVQLVESGGGLVKPGGSLRLSCAASGFTFSDYYMSWIRQAPGKGLEWVSYISSSGSTIYYADSVK<br>GRFTISRDNAKNSLYLQMNSLRAEDTAVYYCARDQGNYGVDVWGQGTTVTVSSGGGGSGGGGSGG<br>GGSGGGGSDIQMTQSPSTLSASVGDRVTITCRASQSISSWLAWYQQKPGKAPKLLIYDASSLESG<br>VPSRFSGSGSGTEFTLTISSLQPDDFATYYCQQVSSLPPTFGGGTKVEIKLEPKSCDKTHTCPPC<br>PIYIWAPLAGTCGVLLLSLVITLYCTKKKYSSSVHDPNGEYMFMRAVNTAKKSRLTDVTLRVKFS<br>RSADAPAYQQGQNQLYNELNLGRREEYDVLDKRRGRDPEMGGKPRRKNPQEGLYNELQKDKMAEA<br>YSEIGMKGERRRGKGHDGLYQGLSTATKDTYDALHMQALPPR |
| 330 | EVQLVESGGGLVKPGGSLRLSCAASGFTFSDYYMSWIRQAPGKGLEWVSYISSSGSTIYYADSVK<br>GRFTISRDNAKNSLYLQMNSLRAEDTAVYYCARDQGNYGVDVWGQGTTVTVSSGGGGSGGGGSGG<br>GGSGGGGSDIQMTQSPSTLSASVGDRVTITCRASQSISSWLAWYQQKPGKAPKLLIYDASSLESG<br>VPSRFSGSGSGTEFTLTISSLQPDDFATYYCQQVSSLPPTFGGGTKVEIKLEPKSCDKTHTCPPC<br>PFWVLVVVGGVLACYSLLVTVAFIIFWVKRGRKKLLYIFKQPEMRPVQTTQEEDGCSCRFPEEEE<br>GGCELRVKFSRSADAPAYQQGQNQLYNELNLGRREEYDVLDKRRGRDPEMGGKPRRKNPQEGLYN<br>ELQKDKMAEAYSEIGMKGERRRGKGHDGLYQGLSTATKDTYDALHMQALPPR |
| 331 | EVQLVESGGGLVKPGGSLRLSCAASGFTFSDYYMSWIRQAPGKGLEWVSYISSSGSTIYYADSVK<br>GRFTISRDNAKNSLYLQMNSLRAEDTAVYYCARDQGNYGVDVWGQGTTVTVSSGGGGSGGGGSGG<br>GGSGGGGSDIQMTQSPSTLSASVGDRVTITCRASQSISSWLAWYQQKPGKAPKLLIYDASSLESG<br>VPSRFSGSGSGTEFTLTISSLQPDDFATYYCQQVSSLPPTFGGGTKVEIKLEPKSCDKTHTCPPC<br>PFWVLVVVGGVLACYSLLVTVAFIIFWVRSKRSRLLHSDYMNMTPRRPGPTRKHYQPYAPPRDFA<br>AYRSRVKFSRSADAPAYQQGQNQLYNELNLGRREEYDVLDKRRGRDPEMGGKPRRKNPQEGLYNE<br>LQKDKMAEAYSEIGMKGERRRGKGHDGLYQGLSTATKDTYDALHMQALPPR |
| 332 | EVQLVESGGGLVKPGGSLRLSCAASGFTFSDYYMSWIRQAPGKGLEWVSYISSSGSTIYYADSVK<br>GRFTISRDNAKNSLYLQMNSLRAEDTAVYYCARDQGNYGVDVWGQGTTVTVSSGGGGSGGGGSGG<br>GGSGGGGSDIQMTQSPSTLSASVGDRVTITCRASQSISSWLAWYQQKPGKAPKLLIYDASSLESG<br>VPSRFSGSGSGTEFTLTISSLQPDDFATYYCQQVSSLPPTFGGGTKVEIKLEPKSCDKTHTCPPC<br>PFWVLVVVGGVLACYSLLVTVAFIIFWVTKKKYSSSVHDPNGEYMFMRAVNTAKKSRLTDVTLRV<br>KFSRSADAPAYQQGQNQLYNELNLGRREEYDVLDKRRGRDPEMGGKPRRKNPQEGLYNELQKDKM<br>AEAYSEIGMKGERRRGKGHDGLYQGLSTATKDTYDALHMQALPPR |
| 333 | DIQMTQSPSTLSASVGDRVTITCRASQSISSWLAWYQQKPGKAPKLLIYDASSLESGVPSRFSGS<br>GSGTEFTLTISSLQPDDFATYYCQQVSSLPPTFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSTTTPAPRPPTPAPTI<br>ASQPLSLRPEACRPAAGGAVHTRGLDFACDIYIWAPLAGTCGVLLLSLVITLYCKRGRKKLLYIF<br>KQPFMRPVQTTQEEDGCSCRFPEEEEGGCELRVKFSRSADAPAYQQGQNQLYNELNLGRREEYDV<br>LDKRRGRDPEMGGKPRRKNPQEGLYNELQKDKMAEAYSEIGMKGERRRGKGHDGLYQGLSTATKD<br>TYDALHMQALPPR |
| 334 | DIQMTQSPSTLSASVGDRVTITCRASQSISSWLAWYQQKPGKAPKLLIYDASSLESGVPSRFSGS<br>GSGTEFTLTISSLQPDDFATYYCQQVSSLPPTFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSTTTPAPRPPTPAPTI<br>ASQPLSLRPEACRPAAGGAVHTRGLDFACDIYIWAPLAGTCGVLLLSLVITLYCRSKRSRLLHSD<br>YMNMTPRRPGPTRKHYQPYAPPRDFAAYRSRVKFSRSADAPAYQQGQNQLYNELNLGRREEYDVL<br>DKRRGRDPEMGGKPRRKNPQEGLYNELQKDKMAEAYSEIGMKGERRRGKGHDGLYQGLSTATKDT<br>YDALHMQALPPR |
| 335 | DIQMTQSPSTLSASVGDRVTITCRASQSISSWLAWYQQKPGKAPKLLIYDASSLESGVPSRFSGS<br>GSGTEFTLTISSLQPDDFATYYCQQVSSLPPTFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSTTTPAPRPPTPAPTI<br>ASQPLSLRPEACRPAAGGAVHTRGLDFACDIYIWAPLAGTCGVLLLSLVITLYCTKKKYSSSVHD<br>PNGEYMFMRAVNTAKKSRLTDVTLRVKFSRSADAPAYQQGQNQLYNELNLGRREEYDVLDKRRGR<br>DPEMGGKPRRKNPQEGLYNELQKDKMAEAYSEIGMKGERRRGKGHDGLYQGLSTATKDTYDALHM<br>QALPPR |
| 336 | DIQMTQSPSTLSASVGDRVTITCRASQSISSWLAWYQQKPGKAPKLLIYDASSLESGVPSRFSGS<br>GSGTEFTLTISSLQPDDFATYYCQQVSSLPPTFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSTTTPAPRPPTPAPTI<br>ASQPLSLRPEACRPAAGGAVHTRGLDFACDFWVLVVVGGVLACYSLLVTVAFIIFWVKRGRKKLL<br>YIFKQPFMRPVQTTQEEDGCSCRFPEEEEGGCELRVKFSRSADAPAYQQGQNQLYNELNLGRREE<br>YDVLDKRRGRDPEMGGKPRRKNPQEGLYNELQKDKMAEAYSEIGMKGERRRGKGHDGLYQGLSTA<br>TKDTYDALHMQALPPR |
| 337 | DIQMTQSPSTLSASVGDRVTITCRASQSISSWLAWYQQKPGKAPKLLIYDASSLESGVPSRFSGS<br>GSGTEFTLTISSLQPDDFATYYCQQVSSLPPTFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSTTTPAPRPPTPAPTI<br>ASQPLSLRPEACRPAAGGAVHTRGLDFACDFWVLVVVGGVLACYSLLVTVAFIIFWVRSKRSRLL<br>HSDYMNMTPRRPGPTRKHYQPYAPPRDFAAYRSRVKFSRSADAPAYQQGQNQLYNELNLGRREEY |

-continued

| SEQ ID NO. | AMINO ACID SEQUENCE |
|---|---|
| | DVLDKRRGRDPEMGGKPRRKNPQEGLYNELQKDKMAEAYSEIGMKGERRRGKGHDGLYQGLSTAT KDTYDALHMQALPPR |
| 338 | DIQMTQSPSTLSASVGDRVTITCRASQSISSWLAWYQQKPGKAPKLLIYDASSLESGVPSRFSGS GSGTEFTLTISSLQPDDFATYYCQQVSSLPPTFGGGTKVEIKGGGGSGGGGSGGGGSGGGGSEVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSTTTPAPRPPTPAPTI ASQPLSLRPEACRPAAGGAVHTRGLDFACDFWVLVVVGGVLACYSLLVTVAFIIFWVTKKKYSSS VHDPNGEYMFMRAVNTAKKSRLTDVTLRVKFSRSADAPAYQQGQNQLYNELNLGRREEYDVLDKR RGRDPEMGGKPRRKNPQEGLYNELQKDKMAEAYSEIGMKGERRRGKGHDGLYQGLSTATKDTYDA LHMQALPPR |
| 339 | DIQMTQSPSTLSASVGDRVTITCRASQSISSWLAWYQQKPGKAPKLLIYDASSLESGVPSRFSGS GSGTEFTLTISSLQPDDFATYYCQQVSSLPPTFGGGTKVEIKGGGGSGGGGSGGGGSGGGGSEVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSIEVMYPPPYLDNEKS NGTIIHVKGKHLCPSPLFPGPSKPIYIWAPLAGTCGVLLLSLVITLYCKRGRKKLLYIFKQPFMR PVQTTQEEDGCSCRFPEEEEGGCELRVKFSRSADAPAYQQGQNQLYNELNLGRREEYDVLDKRRG RDPEMGGKPRRKNPQEGLYNELQKDKMAEAYSEIGMKGERRRGKGHDGLYQGLSTATKDTYDALH MQALPPR |
| 340 | DIQMTQSPSTLSASVGDRVTITCRASQSISSWLAWYQQKPGKAPKLLIYDASSLESGVPSRFSGS GSGTEFTLTISSLQPDDFATYYCQQVSSLPPTFGGGTKVEIKGGGGSGGGGSGGGGSGGGGSEVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSIEVMYPPPYLDNEKS NGTIIHVKGKHLCPSPLFPGPSKPIYIWAPLAGTCGVLLLSLVITLYCRSKRSRLLHSDYMNMTP RRPGPTRKHYQPYAPPRDFAAYRSRVKFSRSADAPAYQQGQNQLYNELNLGRREEYDVLDKRRGR DPEMGGKPRRKNPQEGLYNELQKDKMAEAYSEIGMKGERRRGKGHDGLYQGLSTATKDTYDALHM QALPPR |
| 341 | DIQMTQSPSTLSASVGDRVTITCRASQSISSWLAWYQQKPGKAPKLLIYDASSLESGVPSRFSGS GSGTEFTLTISSLQPDDFATYYCQQVSSLPPTFGGGTKVEIKGGGGSGGGGSGGGGSGGGGSEVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSIEVMYPPPYLDNEKS NGTIIHVKGKHLCPSPLFPGPSKPIYIWAPLAGTCGVLLLSLVITLYCTKKKYSSSVHDPNGEYM FMRAVNTAKKSRLTDVTLRVKFSRSADAPAYQQGQNQLYNELNLGRREEYDVLDKRRGRDPEMGG KPRRKNPQEGLYNELQKDKMAEAYSEIGMKGERRRGKGHDGLYQGLSTATKDTYDALHMQALPPR |
| 342 | DIQMTQSPSTLSASVGDRVTITCRASQSISSWLAWYQQKPGKAPKLLIYDASSLESGVPSRFSGS GSGTEFTLTISSLQPDDFATYYCQQVSSLPPTFGGGTKVEIKGGGGSGGGGSGGGGSGGGGSEVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSIEVMYPPPYLDNEKS NGTIIHVKGKHLCPSPLFPGPSKPFWVLVVVGGVLACYSLLVTVAFIIFWVKRGRKKLLYIFKQP FMRPVQTTQEEDGCSCRFPEEEEGGCELRVKFSRSADAPAYQQGQNQLYNELNLGRREEYDVLDK RRGRDPEMGGKPRRKNPQEGLYNELQKDKMAEAYSEIGMKGERRRGKGHDGLYQGLSTATKDTYD ALHMQALPPR |
| 343 | DIQMTQSPSTLSASVGDRVTITCRASQSISSWLAWYQQKPGKAPKLLIYDASSLESGVPSRFSGS GSGTEFTLTISSLQPDDFATYYCQQVSSLPPTFGGGTKVEIKGGGGSGGGGSGGGGSGGGGSEVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSIEVMYPPPYLDNEKS NGTIIHVKGKHLCPSPLFPGPSKPFWVLVVVGGVLACYSLLVTVAFIIFWVRSKRSRLLHSDYMN MTPRRPGPTRKHYQPYAPPRDFAAYRSRVKFSRSADAPAYQQGQNQLYNELNLGRREEYDVLDKR RGRDPEMGGKPRRKNPQEGLYNELQKDKMAEAYSEIGMKGERRRGKGHDGLYQGLSTATKDTYDA LHMQALPPR |
| 344 | DIQMTQSPSTLSASVGDRVTITCRASQSISSWLAWYQQKPGKAPKLLIYDASSLESGVPSRFSGS GSGTEFTLTISSLQPDDFATYYCQQVSSLPPTFGGGTKVEIKGGGGSGGGGSGGGGSGGGGSEVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSIEVMYPPPYLDNEKS NGTIIHVKGKHLCPSPLFPGPSKPFWVLVVVGGVLACYSLLVTVAFIIFWVTKKKYSSSVHDPNG EYMFMRAVNTAKKSRLTDVTLRVKFSRSADAPAYQQGQNQLYNELNLGRREEYDVLDKRRGRDPE MGGKPRRKNPQEGLYNELQKDKMAEAYSEIGMKGERRRGKGHDGLYQGLSTATKDTYDALHMQAL PPR |
| 345 | DIQMTQSPSTLSASVGDRVTITCRASQSISSWLAWYQQKPGKAPKLLIYDASSLESGVPSRFSGS GSGTEFTLTISSLQPDDFATYYCQQVSSLPPTFGGGTKVEIKGGGGSGGGGSGGGGSGGGGSEVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSESKYGPPCPPCPIYI WAPLAGTCGVLLLSLVITLYCKRGRKKLLYIFKQPFMRPVQTTQEEDGCSCRFPEEEEGGCELRV KFSRSADAPAYQQGQNQLYNELNLGRREEYDVLDKRRGRDPEMGGKPRRKNPQEGLYNELQKDKM AEAYSEIGMKGERRRGKGHDGLYQGLSTATKDTYDALHMQALPPR |
| 346 | DIQMTQSPSTLSASVGDRVTITCRASQSISSWLAWYQQKPGKAPKLLIYDASSLESGVPSRFSGS GSGTEFTLTISSLQPDDFATYYCQQVSSLPPTFGGGTKVEIKGGGGSGGGGSGGGGSGGGGSEVQ |

-continued

| SEQ ID NO. | AMINO ACID SEQUENCE |
|---|---|
| | LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSESKYGPPCPPCPIYI<br>WAPLAGTCGVLLLSLVITLYCRSKRSRLLHSDYMNMTPRRPGPTRKHYQPYAPPRDFAAYRSRVK<br>FSRSADAPAYQQGQNQLYNELNLGRREEYDVLDKRRGRDPEMGGKPRRKNPQEGLYNELQKDKMA<br>EAYSEIGMKGERRRGKGHDGLYQGLSTATKDTYDALHMQALPPR |
| 347 | DIQMTQSPSTLSASVGDRVTITCRASQSISSWLAWYQQKPGKAPKLLIYDASSLESGVPSRFSGS<br>GSGTEFTLTISSLQPDDFATYYCQQVSSLPPTFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSESKYGPPCPPCPIYI<br>WAPLAGTCGVLLLSLVITLYCTKKKYSSSVHDPNGEYMFMRAVNTAKKSRLTDVTLRVKFSRSAD<br>APAYQQGQNQLYNELNLGRREEYDVLDKRRGRDPEMGGKPRRKNPQEGLYNELQKDKMAEAYSEI<br>GMKGERRRGKGHDGLYQGLSTATKDTYDALHMQALPPR |
| 348 | DIQMTQSPSTLSASVGDRVTITCRASQSISSWLAWYQQKPGKAPKLLIYDASSLESGVPSRFSGS<br>GSGTEFTLTISSLQPDDFATYYCQQVSSLPPTFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSESKYGPPCPPCPFWV<br>LVVVGGVLACYSLLVTVAFIIFWVKRGRKKLLYIFKQPFMRPVQTTQEEDGCSCRFPEEEEGGCE<br>LRVKFSRSADAPAYQQGQNQLYNELNLGRREEYDVLDKRRGRDPEMGGKPRRKNPQEGLYNELQK<br>DKMAEAYSEIGMKGERRRGKGHDGLYQGLSTATKDTYDALHMQALPPR |
| 349 | DIQMTQSPSTLSASVGDRVTITCRASQSISSWLAWYQQKPGKAPKLLIYDASSLESGVPSRFSGS<br>GSGTEFTLTISSLQPDDFATYYCQQVSSLPPTFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSESKYGPPCPPCPFWV<br>LVVVGGVLACYSLLVTVAFIIFWVRSKRSRLLHSDYMNMTPRRPGPTRKHYQPYAPPRDFAAYRS<br>RVKFSRSADAPAYQQGQNQLYNELNLGRREEYDVLDKRRGRDPEMGGKPRRKNPQEGLYNELQKD<br>KMAEAYSEIGMKGERRRGKGHDGLYQGLSTATKDTYDALHMQALPPR |
| 350 | DIQMTQSPSTLSASVGDRVTITCRASQSISSWLAWYQQKPGKAPKLLIYDASSLESGVPSRFSGS<br>GSGTEFTLTISSLQPDDFATYYCQQVSSLPPTFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSESKYGPPCPPCPFWV<br>LVVVGGVLACYSLLVTVAFIIFWVTKKKYSSSVHDPNGEYMFMRAVNTAKKSRLTDVTLRVKFSR<br>SADAPAYQQGQNQLYNELNLGRREEYDVLDKRRGRDPEMGGKPRRKNPQEGLYNELQKDKMAEAY<br>SEIGMKGERRRGKGHDGLYQGLSTATKDTYDALHMQALPPR |
| 351 | DIQMTQSPSTLSASVGDRVTITCRASQSISSWLAWYQQKPGKAPKLLIYDASSLESGVPSRFSGS<br>GSGTEFTLTISSLQPDDFATYYCQQVSSLPPTFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSLEPKSCDKTHTCPPC<br>PIYIWAPLAGTCGVLLLSLVITLYCKRGRKKLLYIFKQPFMRPVQTTQEEDGCSCRFPEEEEGGC<br>ELRVKFSRSADAPAYQQGQNQLYNELNLGRREEYDVLDKRRGRDPEMGGKPRRKNPQEGLYNELQ<br>KDKMAEAYSEIGMKGERRRGKGHDGLYQGLSTATKDTYDALHMQALPPR |
| 352 | DIQMTQSPSTLSASVGDRVTITCRASQSISSWLAWYQQKPGKAPKLLIYDASSLESGVPSRFSGS<br>GSGTEFTLTISSLQPDDFATYYCQQVSSLPPTFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSLEPKSCDKTHTCPPC<br>PIYIWAPLAGTCGVLLLSLVITLYCRSKRSRLLHSDYMNMTPRRPGPTRKHYQPYAPPRDFAAYR<br>SRVKFSRSADAPAYQQGQNQLYNELNLGRREEYDVLDKRRGRDPEMGGKPRRKNPQEGLYNELQK<br>DKMAEAYSEIGMKGERRRGKGHDGLYQGLSTATKDTYDALHMQALPPR |
| 353 | DIQMTQSPSTLSASVGDRVTITCRASQSISSWLAWYQQKPGKAPKLLIYDASSLESGVPSRFSGS<br>GSGTEFTLTISSLQPDDFATYYCQQVSSLPPTFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSLEPKSCDKTHTCPPC<br>PIYIWAPLAGTCGVLLLSLVITLYCTKKKYSSSVHDPNGEYMFMRAVNTAKKSRLTDVTLRVKFS<br>RSADAPAYQQGQNQLYNELNLGRREEYDVLDKRRGRDPEMGGKPRRKNPQEGLYNELQKDKMAEA<br>YSEIGMKGERRRGKGHDGLYQGLSTATKDTYDALHMQALPPR |
| 354 | DIQMTQSPSTLSASVGDRVTITCRASQSISSWLAWYQQKPGKAPKLLIYDASSLESGVPSRFSGS<br>GSGTEFTLTISSLQPDDFATYYCQQVSSLPPTFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSLEPKSCDKTHTCPPC<br>PFWVLVVVGGVLACYSLLVTVAFIIFWVKRGRKKLLYIFKQPFMRPVQTTQEEDGCSCRFPEEEE<br>GGCELRVKFSRSADAPAYQQGQNQLYNELNLGRREEYDVLDKRRGRDPEMGGKPRRKNPQEGLYN<br>ELQKDKMAEAYSEIGMKGERRRGKGHDGLYQGLSTATKDTYDALHMQALPPR |
| 355 | DIQMTQSPSTLSASVGDRVTITCRASQSISSWLAWYQQKPGKAPKLLIYDASSLESGVPSRFSGS<br>GSGTEFTLTISSLQPDDFATYYCQQVSSLPPTFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSLEPKSCDKTHTCPPC<br>PFWVLVVVGGVLACYSLLVTVAFIIFWVRSKRSRLLHSDYMNMTPRRPGPTRKHYQPYAPPRDFA |

-continued

| SEQ ID NO. | AMINO ACID SEQUENCE |
|---|---|
| | AYRSRVKFSRSADAPAYQQGQNQLYNELNLGRREEYDVLDKRRGRDPEMGGKPRRKNPQEGLYNE LQKDKMAEAYSEIGMKGERRRGKGHDGLYQGLSTATKDTYDALHMQALPPR |
| 356 | DIQMTQSPSTLSASVGDRVTITCRASQSISSWLAWYQQKPGKAPKLLIYDASSLESGVPSRFSGS GSGTEFTLTISSLQPDDFATYYCQQVSSLPPTFGGGTKVEIKGGGGSGGGGSGGGGSGGGGSEVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSLEPKSCDKTHTCPPC PFWVLVVVGGVLACYSLLVTVAFIIFWVTKKKYSSSVHDPNGEYMFMRAVNTAKKSRLTDVTLRV KFSRSADAPAYQQGQNQLYNELNLGRREEYDVLDKRRGRDPEMGGKPRRKNPQEGLYNELQKDKM AEAYSEIGMKGERRRGKGHDGLYQGLSTATKDTYDALHMQALPPR |

In preferred embodiments, a CAR comprises an antibody or antigen binding fragment thereof comprising an amino acid sequence set forth in SEQ ID NO: 59; a spacer domain comprising an amino acid sequence set forth in SEQ ID NO: 145, SEQ ID NO: 146, SEQ ID NO: 148, or SEQ ID NO: 150; a transmembrane domain comprising an amino acid sequence set forth in SEQ ID NO: 151 or SEQ ID NO: 153; a costimulatory domain comprising an amino acid sequence set forth in SEQ ID NO: 159, SEQ ID NO: 160, or SEQ ID NO: 162; and a primary signaling domain comprising an amino acid sequence set forth in SEQ ID NO: 158. In preferred embodiments, a CAR comprises an amino acid sequence set forth in any one of SEQ ID NOs: 357, 358, 359, 360, 361, 362,363, 364, 365, 366, 367, 368, 369, 370 371, 372, 373, 374, 375, 376, 377, 378, 379, and 380.

| SEQ ID NO. | AMINO ACID SEQUENCE |
|---|---|
| 357 | QVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG VPSRFSGSGSGTEFTLTISSLQPDDFATYYCQQSDSHPITFGGGTKVEIKTTTPAPRPPTPAPTI ASQPLSLRPEACRPAAGGAVHTRGLDFACDIYIWAPLAGTCGVLLLSLVITLYCKRGRKKLLYIF KQPFMRPVQTTQEEDGCSCRFPEEEEGGCELRVKFSRSADAPAYQQGQNQLYNELNLGRREEYDV LDKRRGRDPEMGGKPRRKNPQEGLYNELQKDKMAEAYSEIGMKGERRRGKGHDGLYQGLSTATKD TYDALHMQALPPR |
| 358 | QVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG VPSRFSGSGSGTEFTLTISSLQPDDFATYYCQQSDSHPITFGGGTKVEIKTTTPAPRPPTPAPTI ASQPLSLRPEACRPAAGGAVHTRGLDFACDIYIWAPLAGTCGVLLLSLVITLYCRSKRSRLLHSD YMNMTPRRPGPTRKHYQPYAPPRDFAAYRSRVKFSRSADAPAYQQGQNQLYNELNLGRREEYDVL DKRRGRDPEMGGKPRRKNPQEGLYNELQKDKMAEAYSEIGMKGERRRGKGHDGLYQGLSTATKDT YDALHMQALPPR |
| 359 | QVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG VPSRFSGSGSGTEFTLTISSLQPDDFATYYCQQSDSHPITFGGGTKVEIKTTTPAPRPPTPAPTI ASQPLSLRPEACRPAAGGAVHTRGLDFACDIYIWAPLAGTCGVLLLSLVITLYCTKKKYSSSVHD PNGEYMEMRAVNTAKKSRLTDVTLRVKFSRSADAPAYQQGQNQLYNELNLGRREEYDVLDKRRGR DPEMGGKPRRKNPQEGLYNELQKDKMAEAYSEIGMKGERRRGKGHDGLYQGLSTATKDTYDALHM QALPPR |
| 360 | QVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGGGGGSGG GGSGGGGSDIQMTQSPSTLSASVGDRVTITCRASQSISSWLAWYQQKPGKAPKLLIYEASSLESG VPSRFSGSGSGTEFTLTISSLQPDDFATYYCQQSDSHPITFGGGTKVEIKTTTPAPRPPTPAPTI ASQPLSLRPEACRPAAGGAVHTRGLDFACDFWVLVVVGGVLACYSLLVTVAFIIFWVKRGRKKLL YIFKQPFMRPVQTTQEEDGCSCRFPEEEEGGCELRVKFSRSADAPAYQQGQNQLYNELNLGRREE YDVLDKRRGRDPEMGGKPRRKNPQEGLYNELQKDKMAEAYSEIGMKGERRRGKGHDGLYQGLSTA TKDTYDALHMQALPPR |
| 361 | QVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG VPSRFSGSGSGTEFTLTISSLQPDDFATYYCQQSDSHPITFGGGTKVEIKTTTPAPRPPTPAPTI ASQPLSLRPEACRPAAGGAVHTRGLDFACDFWVLVVVGGVLACYSLLVTVAFIIFWVRSKRSRLL HSDYMNMTPRRPGPTRKHYQPYAPPRDFAAYRSRVKFSRSADAPAYQQGQNQLYNELNLGRREEY DVLDKRRGRDPEMGGKPRRKNPQEGLYNELQKDKMAEAYSEIGMKGERRRGKGHDGLYQGLSTAT KDTYDALHMQALPPR |
| 362 | QVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG |

| SEQ ID NO. | AMINO ACID SEQUENCE |
|---|---|
| | VPSRFSGSGSGTEFTLTISSLQPDDFATYYCQQSDSHPITFGGGTKVEIKTTTPAPRPPTPAPTI ASQPLSLRPEACRPAAGGAVHTRGLDFACDFWVLVVVGGVLACYSLLVTVAFIIFWVTKKKYSSS VHDPNGEYMEMRAVNTAKKSRLTDVTLRVKFSRSADAPAYQQGQNQLYNELNLGRREEYDVLDKR RGRDPEMGGKPRRKNPQEGLYNELQKDKMAEAYSEIGMKGERRRGKGHDGLYQGLSTATKDTYDA LHMQALPPR |
| 363 | QVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG VPSRFSGSGSGTEFTLTISSLQPDDFATYYCQQSDSHPITFGGGTKVEIKIEVMYPPPYLDNEKS NGTIIHVKGKHLCPSPLFPGPSKPIYIWAPLAGTCGVLLLSLVITLYCKRGRKKLLYIFKQPFMR PVQTTQEEDGCSCRFPEEEEGGCELRVKFSRSADAPAYQQGQNQLYNELNLGRREEYDVLDKRRG RDPEMGGKPRRKNPQEGLYNELQKDKMAEAYSEIGMKGERRRGKGHDGLYQGLSTATKDTYDALH MQALPPR |
| 364 | QVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG VPSRFSGSGSGTEFTLTISSLQPDDFATYYCQQSDSHPITFGGGTKVEIKIEVMYPPPYLDNEKS NGTIIHVKGKHLCPSPLFPGPSKPIYIWAPLAGTCGVLLLSLVITLYCRSKRSRLLHSDYMNMTP RRPGPTRKHYQPYAPPRDFAAYRSRVKFSRSADAPAYQQGQNQLYNELNLGRREEYDVLDKRRGR DPEMGGKPRRKNPQEGLYNELQKDKMAEAYSEIGMKGERRRGKGHDGLYQGLSTATKDTYDALHM QALPPR |
| 365 | QVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG VPSRFSGSGSGTEFTLTISSLQPDDFATYYCQQSDSHPITFGGGTKVEIKIEVMYPPPYLDNEKS NGTIIHVKGKHLCPSPLFPGPSKPIYIWAPLAGTCGVLLLSLVITLYCTKKKYSSSVHDPNGEYM FMRAVNTAKKSRLTDVTLRVKFSRSADAPAYQQGQNQLYNELNLGRREEYDVLDKRRGRDPEMGG KPRRKNPQEGLYNELQKDKMAEAYSEIGMKGERRRGKGHDGLYQGLSTATKDTYDALHMQALPPR |
| 366 | QVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG VPSRFSGSGSGTEFTLTISSLQPDDFATYYCQQSDSHPITFGGGTKVEIKIEVMYPPPYLDNEKS NGTIIHVKGKHLCPSPLFPGPSKPFWVLVVVGGVLACYSLLVTVAFIIFWVKRGRKKLLYIFKQP FMRPVQTTQEEDGCSCRFPEEEEGGCELRVKFSRSADAPAYQQGQNQLYNELNLGRREEYDVLDK RRGRDPEMGGKPRRKNPQEGLYNELQKDKMAEAYSEIGMKGERRRGKGHDGLYQGLSTATKDTYD ALHMQALPPR |
| 367 | QVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG VPSRFSGSGSGTEFTLTISSLQPDDFATYYCQQSDSHPITFGGGTKVEIKIEVMYPPPYLDNEKS NGTIIHVKGKHLCPSPLFPGPSKPFWVLVVVGGVLACYSLLVTVAFIIFWVRSKRSRLLHSDYMN MTPRRPGPTRKHYQPYAPPRDFAAYRSRVKFSRSADAPAYQQGQNQLYNELNLGRREEYDVLDKR RGRDPEMGGKPRRKNPQEGLYNELQKDKMAEAYSEIGMKGERRRGKGHDGLYQGLSTATKDTYDA LHMQALPPR |
| 368 | QVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG VPSRFSGSGSGTEFTLTISSLQPDDFATYYCQQSDSHPITFGGGTKVEIKIEVMYPPPYLDNEKS NGTIIHVKGKHLCPSPLFPGPSKPFWVLVVVGGVLACYSLLVTVAFIIFWVTKKKYSSSVHDPNG EYMEMRAVNTAKKSRLTDVTLRVKFSRSADAPAYQQGQNQLYNELNLGRREEYDVLDKRRGRDPE MGGKPRRKNPQEGLYNELQKDKMAEAYSEIGMKGERRRGKGHDGLYQGLSTATKDTYDALHMQAL PPR |
| 369 | QVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG VPSRFSGSGSGTEFTLTISSLQPDDFATYYCQQSDSHPITFGGGTKVEIKESKYGPPCPPCPIYI WAPLAGTCGVLLLSLVITLYCKRGRKKLLYIFKQPFMRPVQTTQEEDGCSCRFPEEEEGGCELRV KFSRSADAPAYQQGQNQLYNELNLGRREEYDVLDKRRGRDPEMGGKPRRKNPQEGLYNELQKDKM AEAYSEIGMKGERRRGKGHDGLYQGLSTATKDTYDALHMQALPPR |
| 370 | QVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG VPSRFSGSGSGTEFTLTISSLQPDDFATYYCQQSDSHPITFGGGTKVEIKESKYGPPCPPCPIYI WAPLAGTCGVLLLSLVITLYCRSKRSRLLHSDYMNMTPRRPGPTRKHYQPYAPPRDFAAYRSRVK FSRSADAPAYQQGQNQLYNELNLGRREEYDVLDKRRGRDPEMGGKPRRKNPQEGLYNELQKDKMA EAYSEIGMKGERRRGKGHDGLYQGLSTATKDTYDALHMQALPPR |

-continued

| SEQ ID NO. | AMINO ACID SEQUENCE |
|---|---|
| 371 | QVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG VPSRFSGSGSGTEFTLTISSLQPDDFATYYCQQSDSHPITFGGGTKVEIKESKYGPPCPPCPIYI WAPLAGTCGVLLLSLVITLYCTKKKYSSSVHDPNGEYMFMRAVNTAKKSRLTDVTLRVKFSRSAD APAYQQGQNQLYNELNLGRREEYDVLDKRRGRDPEMGGKPRRKNPQEGLYNELQKDKMAEAYSEI GMKGERRRGKGHDGLYQGLSTATKDTYDALHMQALPPR |
| 372 | QVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG VPSRFSGSGSGTEFTLTISSLQPDDFATYYCQQSDSHPITFGGGTKVEIKESKYGPPCPPCPFWV LVVVGGVLACYSLLVTVAFIIFWVKRGRKKLLYIFKQPEMRPVQTTQEEDGCSCRFPEEEEGGCE LRVKFSRSADAPAYQQGQNQLYNELNLGRREEYDVLDKRRGRDPEMGGKPRRKNPQEGLYNELQK DKMAEAYSEIGMKGERRRGKGHDGLYQGLSTATKDTYDALHMQALPPR |
| 373 | QVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG VPSRFSGSGSGTEFTLTISSLQPDDFATYYCQQSDSHPITFGGGTKVEIKESKYGPPCPPCPFWV LVVVGGVLACYSLLVTVAFIIFWVRSKRSRLLHSDYMNMTPRRPGPTRKHYQPYAPPRDFAAYRS RVKFSRSADAPAYQQGQNQLYNELNLGRREEYDVLDKRRGRDPEMGGKPRRKNPQEGLYNELQKD KMAEAYSEIGMKGERRRGKGHDGLYQGLSTATKDTYDALHMQALPPR |
| 374 | QVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG VPSRFSGSGSGTEFTLTISSLQPDDFATYYCQQSDSHPITFGGGTKVEIKESKYGPPCPPCPFWV LVVVGGVLACYSLLVTVAFIIFWVTKKKYSSSVHDPNGEYMFMRAVNTAKKSRLTDVTLRVKFSR SADAPAYQQGQNQLYNELNLGRREEYDVLDKRRGRDPEMGGKPRRKNPQEGLYNELQKDKMAEAY SEIGMKGERRRGKGHDGLYQGLSTATKDTYDALHMQALPPR |
| 375 | QVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG VPSRFSGSGSGTEFTLTISSLQPDDFATYYCQQSDSHPITFGGGTKVEIKLEPKSCDKTHTCPPC PIYIWAPLAGTCGVLLLSLVITLYCKRGRKKLLYIFKQPFMRPVQTTQEEDGCSCRFPEEEEGGC ELRVKFSRSADAPAYQQGQNQLYNELNLGRREEYDVLDKRRGRDPEMGGKPRRKNPQEGLYNELQ KDKMAEAYSEIGMKGERRRGKGHDGLYQGLSTATKDTYDALHMQALPPR |
| 376 | QVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG VPSRFSGSGSGTEFTLTISSLQPDDFATYYCQQSDSHPITFGGGTKVEIKLEPKSCDKTHTCPPC PIYIWAPLAGTCGVLLLSLVITLYCRSKRSRLLHSDYMNMTPRRPGPTRKHYQPYAPPRDFAAYR SRVKFSRSADAPAYQQGQNQLYNELNLGRREEYDVLDKRRGRDPEMGGKPRRKNPQEGLYNELQK DKMAEAYSEIGMKGERRRGKGHDGLYQGLSTATKDTYDALHMQALPPR |
| 377 | QVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG VPSRFSGSGSGTEFTLTISSLQPDDFATYYCQQSDSHPITFGGGTKVEIKLEPKSCDKTHTCPPC PIYIWAPLAGTCGVLLLSLVITLYCTKKKYSSSVHDPNGEYMFMRAVNTAKKSRLTDVTLRVKFS RSADAPAYQQGQNQLYNELNLGRREEYDVLDKRRGRDPEMGGKPRRKNPQEGLYNELQKDKMAEA YSEIGMKGERRRGKGHDGLYQGLSTATKDTYDALHMQALPPR |
| 378 | QVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG VPSRFSGSGSGTEFTLTISSLQPDDFATYYCQQSDSHPITFGGGTKVEIKLEPKSCDKTHTCPPC PFWVLVVVGGVLACYSLLVTVAFIIFWVKRGRKKLLYIFKQPFMRPVQTTQEEDGCSCRFPEEEE GGCELRVKFSRSADAPAYQQGQNQLYNELNLGRREEYDVLDKRRGRDPEMGGKPRRKNPQEGLYN ELQKDKMAEAYSEIGMKGERRRGKGHDGLYQGLSTATKDTYDALHMQALPPR |
| 379 | QVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG VPSRFSGSGSGTEFTLTISSLQPDDFATYYCQQSDSHPITFGGGTKVEIKLEPKSCDKTHTCPPC PFWVLVVVGGVLACYSLLVTVAFIIFWVRSKRSRLLHSDYMNMTPRRPGPTRKHYQPYAPPRDFA AYRSRVKFSRSADAPAYQQGQNQLYNELNLGRREEYDVLDKRRGRDPEMGGKPRRKNPQEGLYNE LQKDKMAEAYSEIGMKGERRRGKGHDGLYQGLSTATKDTYDALHMQALPPR |
| 380 | QVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG |

-continued

| SEQ ID NO. | AMINO ACID SEQUENCE |
|---|---|
| | VPSRFSGSGSGTEFTLTISSLQPDDFATYYCQQSDSHPITFGGGTKVEIKLEPKSCDKTHTCPPC PFWVLVVVGGVLACYSLLVTVAFIIFWVTKKKYSSSVHDPNGEYMFMRAVNTAKKSRLTDVTLRV KFSRSADAPAYQQGQNQLYNELNLGRREEYDVLDKRRGRDPEMGGKPRRKNPQEGLYNELQKDKM AEAYSEIGMKGERRRGKGHDGLYQGLSTATKDTYDALHMQALPPR |

In particular embodiments, a CAR comprises an antibody or antigen binding fragment thereof comprising an amino acid sequence set forth in SEQ ID NO: 60; a spacer domain comprising an amino acid sequence set forth in SEQ ID NO: 145, SEQ ID NO: 146, SEQ ID NO: 148, or SEQ ID NO: 150; a transmembrane domain comprising an amino acid sequence set forth in SEQ ID NO: 151 or SEQ ID NO: 153; a costimulatory domain comprising an amino acid sequence set forth in SEQ ID NO: 159, SEQ ID NO: 160, or SEQ ID NO: 162; and a primary signaling domain comprising an amino acid sequence set forth in SEQ ID NO: 158. In particular embodiments, a CAR comprises an amino acid sequence set forth in any one of SEQ ID NOs: 381, 382, 383, 384, 385, 386, 387, 388, 389, 390, 391, 392, 393, 394, 395, 396, 397, 398, 399, 400, 401, 402, 403, and 404.

| SEQ ID NO. | AMINO ACID SEQUENCE |
|---|---|
| 381 | DIQMTQSPSTLSASVGDRVTITCRASQSISSWLAWYQQKPGKAPKLLIYEASSLESGVPSRESGS GSGTEFTLTISSLQPDDFATYYCQQSDSHPITFGGGTKVEIKGGGGSGGGGSGGGGSGGGGSQVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSTTTPAPRPPTPAPTI ASQPLSLRPEACRPAAGGAVHTRGLDFACDIYIWAPLAGTCGVLLLSLVITLYCKRGRKKLLYIF KQPFMRPVQTTQEEDGCSCRFPEEEEGGCELRVKFSRSADAPAYQQGQNQLYNELNLGRREEYDV LDKRRGRDPEMGGKPRRKNPQEGLYNELQKDKMAEAYSEIGMKGERRRGKGHDGLYQGLSTATKD TYDALHMQALPPR |
| 382 | DIQMTQSPSTLSASVGDRVTITCRASQSISSWLAWYQQKPGKAPKLLIYEASSLESGVPSRFSGS GSGTEFTLTISSLQPDDFATYYCQQSDSHPITFGGGTKVEIKGGGGSGGGGSGGGGSGGGGSQVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSTTTPAPRPPTPAPTI ASQPLSLRPEACRPAAGGAVHTRGLDFACDIYIWAPLAGTCGVLLLSLVITLYCRSKRSRLLHSD YMNMTPRRPGPTRKHYQPYAPPRDFAAYRSRVKFSRSADAPAYQQGQNQLYNELNLGRREEYDVL DKRRGRDPEMGGKPRRKNPQEGLYNELQKDKMAEAYSEIGMKGERRRGKGHDGLYQGLSTATKDT YDALHMQALPPR |
| 383 | DIQMTQSPSTLSASVGDRVTITCRASQSISSWLAWYQQKPGKAPKLLIYEASSLESGVPSRFSGS GSGTEFTLTISSLQPDDFATYYCQQSDSHPITFGGGTKVEIKGGGGSGGGGSGGGGSGGGGSQVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSTTTPAPRPPTPAPTI ASQPLSLRPEACRPAAGGAVHTRGLDFACDIYIWAPLAGTCGVLLLSLVITLYCTKKKYSSSVHD PNGEYMFMRAVNTAKKSRLTDVTLRVKFSRSADAPAYQQGQNQLYNELNLGRREEYDVLDKRRGR DPEMGGKPRRKNPQEGLYNELQKDKMAEAYSEIGMKGERRRGKGHDGLYQGLSTATKDTYDALHM QALPPR |
| 384 | DIQMTQSPSTLSASVGDRVTITCRASQSISSWLAWYQQKPGKAPKLLIYEASSLESGVPSRFSGS GSGTEFTLTISSLQPDDFATYYCQQSDSHPITFGGGTKVEIKGGGGSGGGGSGGGGSGGGGSQVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSTTTPAPRPPTPAPTI ASQPLSLRPEACRPAAGGAVHTRGLDFACDFWVLVVVGGVLACYSLLVTVAFIIFWVKRGRKKLL YIFKQPFMRPVQTTQEEDGCSCRFPEEEEGGCELRVKFSRSADAPAYQQGQNQLYNELNLGRREE YDVLDKRRGRDPEMGGKPRRKNPQEGLYNELQKDKMAEAYSEIGMKGERRRGKGHDGLYQGLSTA TKDTYDALHMQALPPR |
| 385 | DIQMTQSPSTLSASVGDRVTITCRASQSISSWLAWYQQKPGKAPKLLIYEASSLESGVPSRFSGS GSGTEFTLTISSLQPDDFATYYCQQSDSHPITFGGGTKVEIKGGGGSGGGGSGGGGSGGGGSQVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSTTTPAPRPPTPAPTI ASQPLSLRPEACRPAAGGAVHTRGLDFACDFWVLVVVGGVLACYSLLVTVAFIIFWVRSKRSRLL HSDYMNMTPRRPGPTRKHYQPYAPPRDFAAYRSRVKFSRSADAPAYQQGQNQLYNELNLGRREEY DVLDKRRGRDPEMGGKPRRKNPQEGLYNELQKDKMAEAYSEIGMKGERRRGKGHDGLYQGLSTAT KDTYDALHMQALPPR |
| 386 | DIQMTQSPSTLSASVGDRVTITCRASQSISSWLAWYQQKPGKAPKLLIYEASSLESGVPSRFSGS GSGTEFTLTISSLQPDDFATYYCQQSDSHPITFGGGTKVEIKGGGGSGGGGSGGGGSGGGGSQVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSTTTPAPRPPTPAPTI ASQPLSLRPEACRPAAGGAVHTRGLDFACDFWVLVVVGGVLACYSLLVTVAFIIFWVTKKKYSSS VHDPNGEYMFMRAVNTAKKSRLTDVTLRVKFSRSADAPAYQQGQNQLYNELNLGRREEYDVLDKR RGRDPEMGGKPRRKNPQEGLYNELQKDKMAEAYSEIGMKGERRRGKGHDGLYQGLSTATKDTYDA LHMQALPPR |

-continued

| SEQ ID NO. | AMINO ACID SEQUENCE |
|---|---|
| 387 | DIQMTQSPSTLSASVGDRVTITCRASQSISSWLAWYQQKPGKAPKLLIYEASSLESGVPSRFSGS GSGTEFTLTISSLQPDDFATYYCQQSDSHPITFGGGTKVEIKGGGGSGGGGSGGGGSGGGGSQVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSIEVMYPPPYLDNEKS NGTIIHVKGKHLCPSPLFPGPSKPIYIWAPLAGTCGVLLLSLVITLYCKRGRKKLLYIFKQPFMR PVQTTQEEDGCSCRFPEEEEGGCELRVKFSRSADAPAYQQGQNQLYNELNLGRREEYDVLDKRRG RDPEMGGKPRRKNPQEGLYNELQKDKMAEAYSEIGMKGERRRGKGHDGLYQGLSTATKDTYDALH MQALPPR |
| 388 | DIQMTQSPSTLSASVGDRVTITCRASQSISSWLAWYQQKPGKAPKLLIYEASSLESGVPSRFSGS GSGTEFTLTISSLQPDDFATYYCQQSDSHPITFGGGTKVEIKGGGGSGGGGSGGGGSGGGGSQVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSIEVMYPPPYLDNEKS NGTIIHVKGKHLCPSPLFPGPSKPIYIWAPLAGTCGVLLLSLVITLYCRSKRSRLLHSDYMNMTP RRPGPTRKHYQPYAPPRDFAAYRSRVKFSRSADAPAYQQGQNQLYNELNLGRREEYDVLDKRRGR DPEMGGKPRRKNPQEGLYNELQKDKMAEAYSEIGMKGERRRGKGHDGLYQGLSTATKDTYDALHM QALPPR |
| 389 | DIQMTQSPSTLSASVGDRVTITCRASQSISSWLAWYQQKPGKAPKLLIYEASSLESGVPSRFSGS GSGTEFTLTISSLQPDDFATYYCQQSDSHPITFGGGTKVEIKGGGGSGGGGSGGGGSGGGGSQVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSIEVMYPPPYLDNEKS NGTIIHVKGKHLCPSPLFPGPSKPIYIWAPLAGTCGVLLLSLVITLYCTKKKYSSSVHDPNGEYM FMRAVNTAKKSRLTDVTLRVKFSRSADAPAYQQGQNQLYNELNLGRREEYDVLDKRRGRDPEMGG KPRRKNPQEGLYNELQKDKMAEAYSEIGMKGERRRGKGHDGLYQGLSTATKDTYDALHMQALPPR |
| 390 | DIQMTQSPSTLSASVGDRVTITCRASQSISSWLAWYQQKPGKAPKLLIYEASSLESGVPSRFSGS GSGTEFTLTISSLQPDDFATYYCQQSDSHPITFGGGTKVEIKGGGGSGGGGSGGGGSGGGGSQVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSIEVMYPPPYLDNEKS NGTIIHVKGKHLCPSPLFPGPSKPFWVLVVVGGVLACYSLLVTVAFIIFWVKRGRKKLLYIFKQP FMRPVQTTQEEDGCSCRFPEEEEGGCELRVKFSRSADAPAYQQGQNQLYNELNLGRREEYDVLDK RRGRDPEMGGKPRRKNPQEGLYNELQKDKMAEAYSEIGMKGERRRGKGHDGLYQGLSTATKDTYD ALHMQALPPR |
| 391 | DIQMTQSPSTLSASVGDRVTITCRASQSISSWLAWYQQKPGKAPKLLIYEASSLESGVPSRFSGS GSGTEFTLTISSLQPDDFATYYCQQSDSHPITFGGGTKVEIKGGGGSGGGGSGGGGSGGGGSQVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSIEVMYPPPYLDNEKS NGTIIHVKGKHLCPSPLFPGPSKPFWVLVVVGGVLACYSLLVTVAFIIFWVRSKRSRLLHSDYMN MTPRRPGPTRKHYQPYAPPRDFAAYRSRVKFSRSADAPAYQQGQNQLYNELNLGRREEYDVLDKR RGRDPEMGGKPRRKNPQEGLYNELQKDKMAEAYSEIGMKGERRRGKGHDGLYQGLSTATKDTYDA LHMQALPPR |
| 392 | DIQMTQSPSTLSASVGDRVTITCRASQSISSWLAWYQQKPGKAPKLLIYEASSLESGVPSRFSGS GSGTEFTLTISSLQPDDFATYYCQQSDSHPITFGGGTKVEIKGGGGSGGGGSGGGGSGGGGSQVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSIEVMYPPPYLDNEKS NGTIIHVKGKHLCPSPLFPGPSKPFWVLVVVGGVLACYSLLVTVAFIIFWVTKKKYSSSVHDPNG EYMFMRAVNTAKKSRLTDVTLRVKFSRSADAPAYQQGQNQLYNELNLGRREEYDVLDKRRGRDPE MGGKPRRKNPQEGLYNELQKDKMAEAYSEIGMKGERRRGKGHDGLYQGLSTATKDTYDALHMQAL PPR |
| 393 | DIQMTQSPSTLSASVGDRVTITCRASQSISSWLAWYQQKPGKAPKLLIYEASSLESGVPSRFSGS GSGTEFTLTISSLQPDDFATYYCQQSDSHPITFGGGTKVEIKGGGGSGGGGSGGGGSGGGGSQVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSESKYGPPCPPCPIYI WAPLAGTCGVLLLSLVITLYCKRGRKKLLYIFKQPFMRPVQTTQEEDGCSCRFPEEEEGGCELRV KFSRSADAPAYQQGQNQLYNELNLGRREEYDVLDKRRGRDPEMGGKPRRKNPQEGLYNELQKDKM AEAYSEIGMKGERRRGKGHDGLYQGLSTATKDTYDALHMQALPPR |
| 394 | DIQMTQSPSTLSASVGDRVTITCRASQSISSWLAWYQQKPGKAPKLLIYEASSLESGVPSRFSGS GSGTEFTLTISSLQPDDFATYYCQQSDSHPITFGGGTKVEIKGGGGSGGGGSGGGGSGGGGSQVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSESKYGPPCPPCPIYI WAPLAGTCGVLLLSLVITLYCRSKRSRLLHSDYMNMTPRRPGPTRKHYQPYAPPRDFAAYRSRVK FSRSADAPAYQQGQNQLYNELNLGRREEYDVLDKRRGRDPEMGGKPRRKNPQEGLYNELQKDKMA EAYSEIGMKGERRRGKGHDGLYQGLSTATKDTYDALHMQALPPR |
| 395 | DIQMTQSPSTLSASVGDRVTITCRASQSISSWLAWYQQKPGKAPKLLIYEASSLESGVPSRFSGS GSGTEFTLTISSLQPDDFATYYCQQSDSHPITFGGGTKVEIKGGGGSGGGGSGGGGSGGGGSQVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSESKYGPPCPPCPIYI |

-continued

| SEQ ID NO. | AMINO ACID SEQUENCE |
|---|---|
| | WAPLAGTCGVLLLSLVITLYCTKKKYSSSVHDPNGEYMEMRAVNTAKKSRLTDVTLRVKFSRSAD APAYQQGQNQLYNELNLGRREEYDVLDKRRGRDPEMGGKPRRKNPQEGLYNELQKDKMAEAYSEI GMKGERRRGKGHDGLYQGLSTATKDTYDALHMQALPPR |
| 396 | DIQMTQSPSTLSASVGDRVTITCRASQSISSWLAWYQQKPGKAPKLLIYEASSLESGVPSRFSGS GSGTEFTLTISSLQPDDFATYYCQQSDSHPITFGGGTKVEIKGGGGSGGGGSGGGGSGGGGSQVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSESKYGPPCPPCPFWV LVVVGGVLACYSLLVTVAFIIFWVKRGRKKLLYIFKQPFMRPVQTTQEEDGCSCRFPEEEEGGCE LRVKFSRSADAPAYQQGQNQLYNELNLGRREEYDVLDKRRGRDPEMGGKPRRKNPQEGLYNELQK DKMAEAYSEIGMKGERRRGKGHDGLYQGLSTATKDTYDALHMQALPPR |
| 397 | DIQMTQSPSTLSASVGDRVTITCRASQSISSWLAWYQQKPGKAPKLLIYEASSLESGVPSRFSGS GSGTEFTLTISSLQPDDFATYYCQQSDSHPITFGGGTKVEIKGGGGSGGGGSGGGGSGGGGSQVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSESKYGPPCPPCPFWV LVVVGGVLACYSLLVTVAFIIFWVRSKRSRLLHSDYMNMTPRRPGPTRKHYQPYAPPRDFAAYRS RVKFSRSADAPAYQQGQNQLYNELNLGRREEYDVLDKRRGRDPEMGGKPRRKNPQEGLYNELQKD KMAEAYSEIGMKGERRRGKGHDGLYQGLSTATKDTYDALHMQALPPR |
| 398 | DIQMTQSPSTLSASVGDRVTITCRASQSISSWLAWYQQKPGKAPKLLIYEASSLESGVPSRFSGS GSGTEFTLTISSLQPDDFATYYCQQSDSHPITFGGGTKVEIKGGGGSGGGGSGGGGSGGGGSQVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSESKYGPPCPPCPFWV LVVVGGVLACYSLLVTVAFIIFWVTKKKYSSSVHDPNGEYMFMRAVNTAKKSRLTDVTLRVKFSR SADAPAYQQGQNQLYNELNLGRREEYDVLDKRRGRDPEMGGKPRRKNPQEGLYNELQKDKMAEAY SEIGMKGERRRGKGHDGLYQGLSTATKDTYDALHMQALPPR |
| 399 | DIQMTQSPSTLSASVGDRVTITCRASQSISSWLAWYQQKPGKAPKLLIYEASSLESGVPSRFSGS GSGTEFTLTISSLQPDDFATYYCQQSDSHPITFGGGTKVEIKGGGGSGGGGSGGGGSGGGGSQVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSLEPKSCDKTHTCPPC PIYIWAPLAGTCGVLLLSLVITLYCKRGRKKLLYIFKQPFMRPVQTTQEEDGCSCRFPEEEEGGC ELRVKFSRSADAPAYQQGQNQLYNELNLGRREEYDVLDKRRGRDPEMGGKPRRKNPQEGLYNELQ KDKMAEAYSEIGMKGERRRGKGHDGLYQGLSTATKDTYDALHMQALPPR |
| 400 | DIQMTQSPSTLSASVGDRVTITCRASQSISSWLAWYQQKPGKAPKLLIYEASSLESGVPSRFSGS GSGTEFTLTISSLQPDDFATYYCQQSDSHPITFGGGTKVEIKGGGGSGGGGSGGGGSGGGGSQVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSLEPKSCDKTHTCPPC PIYIWAPLAGTCGVLLLSLVITLYCRSKRSRLLHSDYMNMTPRRPGPTRKHYQPYAPPRDFAAYR SRVKFSRSADAPAYQQGQNQLYNELNLGRREEYDVLDKRRGRDPEMGGKPRRKNPQEGLYNELQK DKMAEAYSEIGMKGERRRGKGHDGLYQGLSTATKDTYDALHMQALPPR |
| 401 | DIQMTQSPSTLSASVGDRVTITCRASQSISSWLAWYQQKPGKAPKLLIYEASSLESGVPSRFSGS GSGTEFTLTISSLQPDDFATYYCQQSDSHPITFGGGTKVEIKGGGGSGGGGSGGGGSGGGGSQVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSLEPKSCDKTHTCPPC PIYIWAPLAGTCGVLLLSLVITLYCTKKKYSSSVHDPNGEYMEMRAVNTAKKSRLTDVTLRVKFS RSADAPAYQQGQNQLYNELNLGRREEYDVLDKRRGRDPEMGGKPRRKNPQEGLYNELQKDKMAEA YSEIGMKGERRRGKGHDGLYQGLSTATKDTYDALHMQALPPR |
| 402 | DIQMTQSPSTLSASVGDRVTITCRASQSISSWLAWYQQKPGKAPKLLIYEASSLESGVPSRFSGS GSGTEFTLTISSLQPDDFATYYCQQSDSHPITFGGGTKVEIKGGGGSGGGGSGGGGSGGGGSQVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSLEPKSCDKTHTCPPC PFWVLVVVGGVLACYSLLVTVAFIIFWVKRGRKKLLYIFKQPFMRPVQTTQEEDGCSCRFPEEEE GGCELRVKFSRSADAPAYQQGQNQLYNELNLGRREEYDVLDKRRGRDPEMGGKPRRKNPQEGLYN ELQKDKMAEAYSEIGMKGERRRGKGHDGLYQGLSTATKDTYDALHMQALPPR |
| 403 | DIQMTQSPSTLSASVGDRVTITCRASQSISSWLAWYQQKPGKAPKLLIYEASSLESGVPSRFSGS GSGTEFTLTISSLQPDDFATYYCQQSDSHPITFGGGTKVEIKGGGGSGGGGSGGGGSGGGGSQVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSLEPKSCDKTHTCPPC PFWVLVVVGGVLACYSLLVTVAFIIFWVRSKRSRLLHSDYMNMTPRRPGPTRKHYQPYAPPRDFA AYRSRVKFSRSADAPAYQQGQNQLYNELNLGRREEYDVLDKRRGRDPEMGGKPRRKNPQEGLYNE LQKDKMAEAYSEIGMKGERRRGKGHDGLYQGLSTATKDTYDALHMQALPPR |
| 404 | DIQMTQSPSTLSASVGDRVTITCRASQSISSWLAWYQQKPGKAPKLLIYEASSLESGVPSRFSGS GSGTEFTLTISSLQPDDFATYYCQQSDSHPITFGGGTKVEIKGGGGSGGGGSGGGGSGGGGSQVQ LVESGGGLVKPGGSLRLSCAASGFTFSDYYMSWIRQAPGKGLEWVSYISSSGSTIYYADSVKGRF TISRDNAKNSLYLQMNSLRAEDTAVYYCARDQGNYGVDVWGQGTTVTVSSLEPKSCDKTHTCPPC PFWVLVVVGGVLACYSLLVTVAFIIFWVTKKKYSSSVHDPNGEYMFMRAVNTAKKSRLTDVTLRV KFSRSADAPAYQQGQNQLYNELNLGRREEYDVLDKRRGRDPEMGGKPRRKNPQEGLYNELQKDKM AEAYSEIGMKGERRRGKGHDGLYQGLSTATKDTYDALHMQALPPR |

In particular embodiments, a CAR comprises an antibody or antigen binding fragment thereof comprising an amino acid sequence set forth in SEQ ID NO: 69; a spacer domain comprising an amino acid sequence set forth in SEQ ID NO: 145, SEQ ID NO: 146, SEQ ID NO: 148, or SEQ ID NO: 150; a transmembrane domain comprising an amino acid sequence set forth in SEQ ID NO: 151 or SEQ ID NO: 153; a costimulatory domain comprising an amino acid sequence set forth in SEQ ID NO: 159, SEQ ID NO: 160, or SEQ ID NO: 162; and a primary signaling domain comprising an amino acid sequence set forth in SEQ ID NO: 158. In particular embodiments, a CAR comprises an amino acid sequence set forth in any one of SEQ ID NOs: 405, 406, 407, 408, 409, 410, 411, 412, 413, 414, 415, 416, 417, 418, 419, 420, 421, 422, 423, 424, 425, 426, 427, and 428.

| SEQ ID NO. | AMINO ACID SEQUENCE |
|---|---|
| 405 | EVQLVESGGGLVKPGGSLRLSCAASGFTFSDYYMSWIRQAPGKGLEWVSYISSSGSTIYYADSVK<br>GRFTISRDNAKNSLYLQMNSLRAEDTAVYYCARDQGNYGVDVWGQGTTVTVSSGGGGSGGGGSGG<br>GGSGGGGSDIQMTQSPSTLSASVGDRVTITCRASQSISSWLAWYQQKPGKAPKLLIYEASSLESG<br>VPSRFSGSGSGTEFTLTISSLQPDDFATYYCQQANSHPITFGGGTKVEIKTTTPAPRPPTPAPTI<br>ASQPLSLRPEACRPAAGGAVHTRGLDFACDIYIWAPLAGTCGVLLLSLVITLYCKRGRKKLLYIF<br>KQPFMRPVQTTQEEDGCSCRFPEEEEGGCELRVKFSRSADAPAYQQGQNQLYNELNLGRREEYDV<br>LDKRRGRDPEMGGKPRRKNPQEGLYNELQKDKMAEAYSEIGMKGERRRGKGHDGLYQGLSTATKD<br>TYDALHMQALPPR |
| 406 | EVQLVESGGGLVKPGGSLRLSCAASGFTFSDYYMSWIRQAPGKGLEWVSYISSSGSTIYYADSVK<br>GRFTISRDNAKNSLYLQMNSLRAEDTAVYYCARDQGNYGVDVWGQGTTVTVSSGGGGSGGGGSGG<br>GGSGGGGSDIQMTQSPSTLSASVGDRVTITCRASQSISSWLAWYQQKPGKAPKLLIYEASSLESG<br>VPSRFSGSGSGTEFTLTISSLQPDDFATYYCQQANSHPITFGGGTKVEIKTTTPAPRPPTPAPTI<br>ASQPLSLRPEACRPAAGGAVHTRGLDFACDIYIWAPLAGTCGVLLLSLVITLYCRSKRSRLLHSD<br>YMNMTPRRPGPTRKHYQPYAPPRDFAAYRSRVKFSRSADAPAYQQGQNQLYNELNLGRREEYDVL<br>DKRRGRDPEMGGKPRRKNPQEGLYNELQKDKMAEAYSEIGMKGERRRGKGHDGLYQGLSTATKDT<br>YDALHMQALPPR |
| 407 | EVQLVESGGGLVKPGGSLRLSCAASGFTFSDYYMSWIRQAPGKGLEWVSYISSSGSTIYYADSVK<br>GRFTISRDNAKNSLYLQMNSLRAEDTAVYYCARDQGNYGVDVWGQGTTVTVSSGGGGSGGGGSGG<br>GGSGGGGSDIQMTQSPSTLSASVGDRVTITCRASQSISSWLAWYQQKPGKAPKLLIYEASSLESG<br>VPSRFSGSGSGTEFTLTISSLQPDDFATYYCQQANSHPITFGGGTKVEIKTTTPAPRPPTPAPTI<br>ASQPLSLRPEACRPAAGGAVHTRGLDFACDIYIWAPLAGTCGVLLLSLVITLYCTKKKYSSSVHD<br>PNGEYMFMRAVNTAKKSRLTDVTLRVKFSRSADAPAYQQGQNQLYNELNLGRREEYDVLDKRRGR<br>DPEMGGKPRRKNPQEGLYNELQKDKMAEAYSEIGMKGERRRGKGHDGLYQGLSTATKDTYDALHM<br>QALPPR |
| 408 | EVQLVESGGGLVKPGGSLRLSCAASGFTFSDYYMSWIRQAPGKGLEWVSYISSSGSTIYYADSVK<br>GRFTISRDNAKNSLYLQMNSLRAEDTAVYYCARDQGNYGVDVWGQGTTVTVSSGGGGSGGGGSGG<br>GGSGGGGSDIQMTQSPSTLSASVGDRVTITCRASQSISSWLAWYQQKPGKAPKLLIYEASSLESG<br>VPSRFSGSGSGTEFTLTISSLQPDDFATYYCQQANSHPITFGGGTKVEIKTTTPAPRPPTPAPTI<br>ASQPLSLRPEACRPAAGGAVHTRGLDFACDFWVLVVVGGVLACYSLLVTVAFIIFWVKRGRKKLL<br>YIFKQPFMRPVQTTQEEDGCSCRFPEEEEGGCELRVKFSRSADAPAYQQGQNQLYNELNLGRREE<br>YDVLDKRRGRDPEMGGKPRRKNPQEGLYNELQKDKMAEAYSEIGMKGERRRGKGHDGLYQGLSTA<br>TKDTYDALHMQALPPR |
| 409 | EVQLVESGGGLVKPGGSLRLSCAASGFTFSDYYMSWIRQAPGKGLEWVSYISSSGSTIYYADSVK<br>GRFTISRDNAKNSLYLQMNSLRAEDTAVYYCARDQGNYGVDVWGQGTTVTVSSGGGGSGGGGSGG<br>GGSGGGGSDIQMTQSPSTLSASVGDRVTITCRASQSISSWLAWYQQKPGKAPKLLIYEASSLESG<br>VPSRFSGSGSGTEFTLTISSLQPDDFATYYCQQANSHPITFGGGTKVEIKTTTPAPRPPTPAPTI<br>ASQPLSLRPEACRPAAGGAVHTRGLDFACDFWVLVVVGGVLACYSLLVTVAFIIFWVRSKRSRLL<br>HSDYMNMTPRRPGPTRKHYQPYAPPRDFAAYRSRVKFSRSADAPAYQQGQNQLYNELNLGRREEY<br>DVLDKRRGRDPEMGGKPRRKNPQEGLYNELQKDKMAEAYSEIGMKGERRRGKGHDGLYQGLSTAT<br>KDTYDALHMQALPPR |
| 410 | EVQLVESGGGLVKPGGSLRLSCAASGFTFSDYYMSWIRQAPGKGLEWVSYISSSGSTIYYADSVK<br>GRFTISRDNAKNSLYLQMNSLRAEDTAVYYCARDQGNYGVDVWGQGTTVTVSSGGGGSGGGGSGG<br>GGSGGGGSDIQMTQSPSTLSASVGDRVTITCRASQSISSWLAWYQQKPGKAPKLLIYEASSLESG<br>VPSRFSGSGSGTEFTLTISSLQPDDFATYYCQQANSHPITFGGGTKVEIKTTTPAPRPPTPAPTI<br>ASQPLSLRPEACRPAAGGAVHTRGLDFACDFWVLVVVGGVLACYSLLVTVAFIIFWVTKKKYSSS<br>VHDPNGEYMFMRAVNTAKKSRLTDVTLRVKFSRSADAPAYQQGQNQLYNELNLGRREEYDVLDKR<br>RGRDPEMGGKPRRKNPQEGLYNELQKDKMAEAYSEIGMKGERRRGKGHDGLYQGLSTATKDTYDA<br>LHMQALPPR |
| 411 | EVQLVESGGGLVKPGGSLRLSCAASGFTFSDYYMSWIRQAPGKGLEWVSYISSSGSTIYYADSVK<br>GRFTISRDNAKNSLYLQMNSLRAEDTAVYYCARDQGNYGVDVWGQGTTVTVSSGGGGSGGGGSGG<br>GGSGGGGSDIQMTQSPSTLSASVGDRVTITCRASQSISSWLAWYQQKPGKAPKLLIYEASSLESG<br>VPSRFSGSGSGTEFTLTISSLQPDDFATYYCQQANSHPITFGGGTKVEIKIEVMYPPPYLDNEKS<br>NGTIIHVKGKHLCPSPLFPGPSKPIYIWAPLAGTCGVLLLSLVITLYCKRGRKKLLYIFKQPFMR<br>PVQTTQEEDGCSCRFPEEEEGGCELRVKFSRSADAPAYQQGQNQLYNELNLGRREEYDVLDKRRG<br>RDPEMGGKPRRKNPQEGLYNELQKDKMAEAYSEIGMKGERRRGKGHDGLYQGLSTATKDTYDALH<br>MQALPPR |
| 412 | EVQLVESGGGLVKPGGSLRLSCAASGFTFSDYYMSWIRQAPGKGLEWVSYISSSGSTIYYADSVK<br>GRFTISRDNAKNSLYLQMNSLRAEDTAVYYCARDQGNYGVDVWGQGTTVTVSSGGGGSGGGGSGG<br>GGSGGGGSDIQMTQSPSTLSASVGDRVTITCRASQSISSWLAWYQQKPGKAPKLLIYEASSLESG<br>VPSRFSGSGSGTEFTLTISSLQPDDFATYYCQQANSHPITFGGGTKVEIKIEVMYPPPYLDNEKS |

-continued

| SEQ ID NO. | AMINO ACID SEQUENCE |
|---|---|
| | NGTIIHVKGKHLCPSPLFPGPSKPIYIWAPLAGTCGVLLLSLVITLYCRSKRSRLLHSDYMNMTP RRPGPTRKHYQPYAPPRDFAAYRSRVKFSRSADAPAYQQGQNQLYNELNLGRREEYDVLDKRRGR DPEMGGKPRRKNPQEGLYNELQKDKMAEAYSEIGMKGERRRGKGHDGLYQGLSTATKDTYDALHM QALPPR |
| 413 | EVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG VPSRFSGSGSGTEFTLTISSLQPDDFATYYCQQANSHPITFGGGTKVEIKIEVMYPPPYLDNEKS NGTIIHVKGKHLCPSPLFPGPSKPIYIWAPLAGTCGVLLLSLVITLYCTKKKYSSSVHDPNGEYM FMRAVNTAKKSRLTDVTLRVKFSRSADAPAYQQGQNQLYNELNLGRREEYDVLDKRRGRDPEMGG KPRRKNPQEGLYNELQKDKMAEAYSEIGMKGERRRGKGHDGLYQGLSTATKDTYDALHMQALPPR |
| 414 | EVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG VPSRFSGSGSGTEFTLTISSLQPDDFATYYCQQANSHPITFGGGTKVEIKIEVMYPPPYLDNEKS NGTIIHVKGKHLCPSPLFPGPSKPFWVLVVVGGVLACYSLLVTVAFIIFWVKRGRKKLLYIFKQP FMRPVQTTQEEDGCSCRFPEEEEGGCELRVKFSRSADAPAYQQGQNQLYNELNLGRREEYDVLDK RRGRDPEMGGKPRRKNPQEGLYNELQKDKMAEAYSEIGMKGERRRGKGHDGLYQGLSTATKDTYD ALHMQALPPR |
| 415 | EVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG VPSRFSGSGSGTEFTLTISSLQPDDFATYYCQQANSHPITFGGGTKVEIKIEVMYPPPYLDNEKS NGTIIHVKGKHLCPSPLFPGPSKPFWVLVVVGGVLACYSLLVTVAFIIFWVRSKRSRLLHSDYMN MTPRRPGPTRKHYQPYAPPRDFAAYRSRVKFSRSADAPAYQQGQNQLYNELNLGRREEYDVLDKR RGRDPEMGGKPRRKNPQEGLYNELQKDKMAEAYSEIGMKGERRRGKGHDGLYQGLSTATKDTYDA LHMQALPPR |
| 416 | EVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG VPSRFSGSGSGTEFTLTISSLQPDDFATYYCQQANSHPITFGGGTKVEIKIEVMYPPPYLDNEKS NGTIIHVKGKHLCPSPLFPGPSKPFWVLVVVGGVLACYSLLVTVAFIIFWVTKKKYSSSVHDPNG EYMFMRAVNTAKKSRLTDVTLRVKFSRSADAPAYQQGQNQLYNELNLGRREEYDVLDKRRGRDPE MGGKPRRKNPQEGLYNELQKDKMAEAYSEIGMKGERRRGKGHDGLYQGLSTATKDTYDALHMQAL PPR |
| 417 | EVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG VPSRFSGSGSGTEFTLTISSLQPDDFATYYCQQANSHPITFGGGTKVEIKESKYGPPCPPCPIYI WAPLAGTCGVLLLSLVITLYCKRGRKKLLYIFKQPFMRPVQTTQEEDGCSCRFPEEEEGGCELRV KFSRSADAPAYQQGQNQLYNELNLGRREEYDVLDKRRGRDPEMGGKPRRKNPQEGLYNELQKDKM AEAYSEIGMKGERRRGKGHDGLYQGLSTATKDTYDALHMQALPPR |
| 418 | EVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG VPSRFSGSGSGTEFTLTISSLQPDDFATYYCQQANSHPITFGGGTKVEIKESKYGPPCPPCPIYI WAPLAGTCGVLLLSLVITLYCRSKRSRLLHSDYMNMTPRRPGPTRKHYQPYAPPRDFAAYRSRVK FSRSADAPAYQQGQNQLYNELNLGRREEYDVLDKRRGRDPEMGGKPRRKNPQEGLYNELQKDKMA EAYSEIGMKGERRRGKGHDGLYQGLSTATKDTYDALHMQALPPR |
| 419 | EVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG VPSRFSGSGSGTEFTLTISSLQPDDFATYYCQQANSHPITFGGGTKVEIKESKYGPPCPPCPIYI WAPLAGTCGVLLLSLVITLYCTKKKYSSSVHDPNGEYMFMRAVNTAKKSRLTDVTLRVKFSRSAD APAYQQGQNQLYNELNLGRREEYDVLDKRRGRDPEMGGKPRRKNPQEGLYNELQKDKMAEAYSEI GMKGERRRGKGHDGLYQGLSTATKDTYDALHMQALPPR |
| 420 | EVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG VPSRFSGSGSGTEFTLTISSLQPDDFATYYCQQANSHPITFGGGTKVEIKESKYGPPCPPCPFWV LVVVGGVLACYSLLVTVAFIIFWVKRGRKKLLYIFKQPFMRPVQTTQEEDGCSCRFPEEEEGGCE LRVKFSRSADAPAYQQGQNQLYNELNLGRREEYDVLDKRRGRDPEMGGKPRRKNPQEGLYNELQK DKMAEAYSEIGMKGERRRGKGHDGLYQGLSTATKDTYDALHMQALPPR |
| 421 | EVQLVESGGGLVKPGGSLRLSCAASGFTFSDYYMSWIRQAPGKGLEWVSYISSSGSTIYYADSVK GRFTISRDNAKNSLYLQMNSLRAEDTAVYYCARDQGNYGVDVWGQGTTVTVSSGGGGSGGGGSGG GGSGGGGSDIQMTQSPSTLSASVGDRVTITCRASQSISSWLAWYQQKPGKAPKLLIYEASSLESG VPSRFSGSGSGTEFTLTISSLQPDDFATYYCQQANSHPITFGGGTKVEIKESKYGPPCPPCPFWV |

-continued

| SEQ ID NO. | AMINO ACID SEQUENCE |
|---|---|
| | LVVVGGVLACYSLLVTVAFIIFWVRSKRSRLLHSDYMNMTPRRPGPTRKHYQPYAPPRDFAAYRS<br>RVKFSRSADAPAYQQGQNQLYNELNLGRREEYDVLDKRRGRDPEMGGKPRRKNPQEGLYNELQKD<br>KMAEAYSEIGMKGERRRGKGHDGLYQGLSTATKDTYDALHMQALPPR |
| 422 | EVQLVESGGGLVKPGGSLRLSCAASGFTFSDYYMSWIRQAPGKGLEWVSYISSSGSTIYYADSVK<br>GRFTISRDNAKNSLYLQMNSLRAEDTAVYYCARDQGNYGVDVWGQGTTVTVSSGGGGSGGGGSGG<br>GGSGGGGSDIQMTQSPSTLSASVGDRVTITCRASQSISSWLAWYQQKPGKAPKLLIYEASSLESG<br>VPSRFSGSGSGTEFTLTISSLQPDDFATYYCQQANSHPITFGGGTKVEIKESKYGPPCPPCPFWV<br>LVVVGGVLACYSLLVTVAFIIFWVTKKKYSSSVHDPNGEYMFMRAVNTAKKSRLTDVTLRVKFSR<br>SADAPAYQQGQNQLYNELNLGRREEYDVLDKRRGRDPEMGGKPRRKNPQEGLYNELQKDKMAEAY<br>SEIGMKGERRRGKGHDGLYQGLSTATKDTYDALHMQALPPR |
| 423 | EVQLVESGGGLVKPGGSLRLSCAASGFTFSDYYMSWIRQAPGKGLEWVSYISSSGSTIYYADSVK<br>GRFTISRDNAKNSLYLQMNSLRAEDTAVYYCARDQGNYGVDVWGQGTTVTVSSGGGGSGGGGSGG<br>GGSGGGGSDIQMTQSPSTLSASVGDRVTITCRASQSISSWLAWYQQKPGKAPKLLIYEASSLESG<br>VPSRFSGSGSGTEFTLTISSLQPDDFATYYCQQANSHPITFGGGTKVEIKLEPKSCDKTHTCPPC<br>PIYIWAPLAGTCGVLLLSLVITLYCKRGRKKLLYIFKQPEMRPVQTTQEEDGCSCRFPEEEEGGC<br>ELRVKFSRSADAPAYQQGQNQLYNELNLGRREEYDVLDKRRGRDPEMGGKPRRKNPQEGLYNELQ<br>KDKMAEAYSEIGMKGERRRGKGHDGLYQGLSTATKDTYDALHMQALPPR |
| 424 | EVQLVESGGGLVKPGGSLRLSCAASGFTFSDYYMSWIRQAPGKGLEWVSYISSSGSTIYYADSVK<br>GRFTISRDNAKNSLYLQMNSLRAEDTAVYYCARDQGNYGVDVWGQGTTVTVSSGGGGSGGGGSGG<br>GGSGGGGSDIQMTQSPSTLSASVGDRVTITCRASQSISSWLAWYQQKPGKAPKLLIYEASSLESG<br>VPSRFSGSGSGTEFTLTISSLQPDDFATYYCQQANSHPITFGGGTKVEIKLEPKSCDKTHTCPPC<br>PIYIWAPLAGTCGVLLLSLVITLYCRSKRSRLLHSDYMNMTPRRPGPTRKHYQPYAPPRDFAAYR<br>SRVKFSRSADAPAYQQGQNQLYNELNLGRREEYDVLDKRRGRDPEMGGKPRRKNPQEGLYNELQK<br>DKMAEAYSEIGMKGERRRGKGHDGLYQGLSTATKDTYDALHMQALPPR |
| 425 | EVQLVESGGGLVKPGGSLRLSCAASGFTFSDYYMSWIRQAPGKGLEWVSYISSSGSTIYYADSVK<br>GRFTISRDNAKNSLYLQMNSLRAEDTAVYYCARDQGNYGVDVWGQGTTVTVSSGGGGSGGGGSGG<br>GGSGGGGSDIQMTQSPSTLSASVGDRVTITCRASQSISSWLAWYQQKPGKAPKLLIYEASSLESG<br>VPSRFSGSGSGTEFTLTISSLQPDDFATYYCQQANSHPITFGGGTKVEIKLEPKSCDKTHTCPPC<br>PIYIWAPLAGTCGVLLLSLVITLYCTKKKYSSSVHDPNGEYMEMRAVNTAKKSRLTDVTLRVKES<br>RSADAPAYQQGQNQLYNELNLGRREEYDVLDKRRGRDPEMGGKPRRKNPQEGLYNELQKDKMAEA<br>YSEIGMKGERRRGKGHDGLYQGLSTATKDTYDALHMQALPPR |
| 426 | EVQLVESGGGLVKPGGSLRLSCAASGFTFSDYYMSWIRQAPGKGLEWVSYISSSGSTIYYADSVK<br>GRFTISRDNAKNSLYLQMNSLRAEDTAVYYCARDQGNYGVDVWGQGTTVTVSSGGGGSGGGGSGG<br>GGSGGGGSDIQMTQSPSTLSASVGDRVTITCRASQSISSWLAWYQQKPGKAPKLLIYEASSLESG<br>VPSRFSGSGSGTEFTLTISSLQPDDFATYYCQQANSHPITFGGGTKVEIKLEPKSCDKTHTCPPC<br>PFWVLVVVGGVLACYSLLVTVAFIIFWVKRGRKKLLYIFKQPFMRPVQTTQEEDGCSCRFPEEEE<br>GGCELRVKFSRSADAPAYQQGQNQLYNELNLGRREEYDVLDKRRGRDPEMGGKPRRKNPQEGLYN<br>ELQKDKMAEAYSEIGMKGERRRGKGHDGLYQGLSTATKDTYDALHMQALPPR |
| 427 | EVQLVESGGGLVKPGGSLRLSCAASGFTFSDYYMSWIRQAPGKGLEWVSYISSSGSTIYYADSVK<br>GRFTISRDNAKNSLYLQMNSLRAEDTAVYYCARDQGNYGVDVWGQGTTVTVSSGGGGSGGGGSGG<br>GGSGGGGSDIQMTQSPSTLSASVGDRVTITCRASQSISSWLAWYQQKPGKAPKLLIYEASSLESG<br>VPSRFSGSGSGTEFTLTISSLQPDDFATYYCQQANSHPITFGGGTKVEIKLEPKSCDKTHTCPPC<br>PFWVLVVVGGVLACYSLLVTVAFIIFWVRSKRSRLLHSDYMNMTPRRPGPTRKHYQPYAPPRDFA<br>AYRSRVKFSRSADAPAYQQGQNQLYNELNLGRREEYDVLDKRRGRDPEMGGKPRRKNPQEGLYNE<br>LQKDKMAEAYSEIGMKGERRRGKGHDGLYQGLSTATKDTYDALHMQALPPR |
| 428 | EVQLVESGGGLVKPGGSLRLSCAASGFTFSDYYMSWIRQAPGKGLEWVSYISSSGSTIYYADSVK<br>GRFTISRDNAKNSLYLQMNSLRAEDTAVYYCARDQGNYGVDVWGQGTTVTVSSGGGGSGGGGSGG<br>GGSGGGGSDIQMTQSPSTLSASVGDRVTITCRASQSISSWLAWYQQKPGKAPKLLIYEASSLESG<br>VPSRFSGSGSGTEFTLTISSLQPDDFATYYCQQANSHPITFGGGTKVEIKLEPKSCDKTHTCPPC<br>PFWVLVVVGGVLACYSLLVTVAFIIFWVTKKKYSSSVHDPNGEYMEMRAVNTAKKSRLTDVTLRV<br>KFSRSADAPAYQQGQNQLYNELNLGRREEYDVLDKRRGRDPEMGGKPRRKNPQEGLYNELQKDKM<br>AEAYSEIGMKGERRRGKGHDGLYQGLSTATKDTYDALHMQALPPR |

In more preferred embodiments, a CAR comprises an antibody or antigen binding fragment thereof comprising an amino acid sequence set forth in SEQ ID NO: 70; a spacer domain comprising an amino acid sequence set forth in SEQ ID NO: 145, SEQ ID NO: 146, SEQ ID NO: 148, or SEQ ID NO: 150; a transmembrane domain comprising an amino acid sequence set forth in SEQ ID NO: 151 or SEQ ID NO: 153; a costimulatory domain comprising an amino acid sequence set forth in SEQ ID NO: 159, SEQ ID NO: 160, or SEQ ID NO: 162; and a primary signaling domain comprising an amino acid sequence set forth in SEQ ID NO: 158. In preferred embodiments, a CAR comprises an amino acid sequence set forth in any one of SEQ ID NOs: 429, 430, 431, 432, 433, 434, 435, 436, 437, 438, 439, 440, 441, 442, 443, 444, 445, 446, 447, 448, 449, 450, 451, and 452 and in even more preferred embodiments a CAR comprises an amino acid sequence set forth in SEQ ID NO: 429, 432, 435, or 438.

| SEQ ID NO. | AMINO ACID SEQUENCE |
|---|---|
| 429 | DIQMTQSPSTLSASVGDRVTITCRASQSISSWLAWYQQKPGKAPKLLIYEASSLESGVPSRESGS<br>GSGTEFTLTISSLQPDDFATYYCQQANSHPITFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSTTTPAPRPPTPAPTI<br>ASQPLSLRPEACRPAAGGAVHTRGLDFACDIYIWAPLAGTCGVLLLSLVITLYCKRGRKKLLYIF<br>KQPFMRPVQTTQEEDGCSCRFPEEEEGGCELRVKFSRSADAPAYQQGQNQLYNELNLGRREEYDV<br>LDKRRGRDPEMGGKPRRKNPQEGLYNELQKDKMAEAYSEIGMKGERRRGKGHDGLYQGLSTATKD<br>TYDALHMQALPPR |
| 430 | DIQMTQSPSTLSASVGDRVTITCRASQSISSWLAWYQQKPGKAPKLLIYEASSLESGVPSRESGS<br>GSGTEFTLTISSLQPDDFATYYCQQANSHPITFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSTTTPAPRPPTPAPTI<br>ASQPLSLRPEACRPAAGGAVHTRGLDFACDIYIWAPLAGTCGVLLLSLVITLYCRSKRSRLLHSD<br>YMNMTPRRPGPTRKHYQPYAPPRDFAAYRSRVKFSRSADAPAYQQGQNQLYNELNLGRREEYDVL<br>DKRRGRDPEMGGKPRRKNPQEGLYNELQKDKMAEAYSEIGMKGERRRGKGHDGLYQGLSTATKDT<br>YDALHMQALPPR |
| 431 | DIQMTQSPSTLSASVGDRVTITCRASQSISSWLAWYQQKPGKAPKLLIYEASSLESGVPSRESGS<br>GSGTEFTLTISSLQPDDFATYYCQQANSHPITFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSTTTPAPRPPTPAPTI<br>ASQPLSLRPEACRPAAGGAVHTRGLDFACDIYIWAPLAGTCGVLLLSLVITLYCTKKKYSSSVHD<br>PNGEYMFMRAVNTAKKSRLTDVTLRVKFSRSADAPAYQQGQNQLYNELNLGRREEYDVLDKRRGR<br>DPEMGGKPRRKNPQEGLYNELQKDKMAEAYSEIGMKGERRRGKGHDGLYQGLSTATKDTYDALHM<br>QALPPR |
| 432 | DIQMTQSPSTLSASVGDRVTITCRASQSISSWLAWYQQKPGKAPKLLIYEASSLESGVPSRFSGS<br>GSGTEFTLTISSLQPDDFATYYCQQANSHPITFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSTTTPAPRPPTPAPTI<br>ASQPLSLRPEACRPAAGGAVHTRGLDFACDFWVLVVVGGVLACYSLLVTVAFIIFWVKRGRKKLL<br>YIFKQPFMRPVQTTQEEDGCSCRFPEEEEGGCELRVKFSRSADAPAYQQGQNQLYNELNLGRREE<br>YDVLDKRRGRDPEMGGKPRRKNPQEGLYNELQKDKMAEAYSEIGMKGERRRGKGHDGLYQGLSTA<br>TKDTYDALHMQALPPR |
| 433 | DIQMTQSPSTLSASVGDRVTITCRASQSISSWLAWYQQKPGKAPKLLIYEASSLESGVPSRFSGS<br>GSGTEFTLTISSLQPDDFATYYCQQANSHPITFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSTTTPAPRPPTPAPTI<br>ASQPLSLRPEACRPAAGGAVHTRGLDFACDFWVLVVVGGVLACYSLLVTVAFIIFWVRSKRSRLL<br>HSDYMNMTPRRPGPTRKHYQPYAPPRDFAAYRSRVKFSRSADAPAYQQGQNQLYNELNLGRREEY<br>DVLDKRRGRDPEMGGKPRRKNPQEGLYNELQKDKMAEAYSEIGMKGERRRGKGHDGLYQGLSTAT<br>KDTYDALHMQALPPR |
| 434 | DIQMTQSPSTLSASVGDRVTITCRASQSISSWLAWYQQKPGKAPKLLIYEASSLESGVPSRFSGS<br>GSGTEFTLTISSLQPDDFATYYCQQANSHPITFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSTTTPAPRPPTPAPTI<br>ASQPLSLRPEACRPAAGGAVHTRGLDFACDFWVLVVVGGVLACYSLLVTVAFIIFWVTKKKYSSS<br>VHDPNGEYMEMRAVNTAKKSRLTDVTLRVKFSRSADAPAYQQGQNQLYNELNLGRREEYDVLDKR<br>RGRDPEMGGKPRRKNPQEGLYNELQKDKMAEAYSEIGMKGERRRGKGHDGLYQGLSTATKDTYDA<br>LHMQALPPR |
| 435 | DIQMTQSPSTLSASVGDRVTITCRASQSISSWLAWYQQKPGKAPKLLIYEASSLESGVPSRFSGS<br>GSGTEFTLTISSLQPDDFATYYCQQANSHPITFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSIEVMYPPPYLDNEKS<br>NGTIIHVKGKHLCPSPLFPGPSKPIYIWAPLAGTCGVLLLSLVITLYCKRGRKKLLYIFKQPEMR<br>PVQTTQEEDGCCRFPEEEEGGCELRVKFSRSADAPAYQQGQNQLYNELNLGRREEYDVLDKRRG<br>RDPEMGGKPRRKNPQEGLYNELQKDKMAEAYSEIGMKGERRRGKGHDGLYQGLSTATKDTYDALH<br>MQALPPR |
| 436 | DIQMTQSPSTLSASVGDRVTITCRASQSISSWLAWYQQKPGKAPKLLIYEASSLESGVPSRFSGS<br>GSGTEFTLTISSLQPDDFATYYCQQANSHPITFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSIEVMYPPPYLDNEKS<br>NGTIIHVKGKHLCPSPLFPGPSKPIYIWAPLAGTCGVLLLSLVITLYCRSKRSRLLHSDYMNMTP<br>RRPGPTRKHYQPYAPPRDFAAYRSRVKFSRSADAPAYQQGQNQLYNELNLGRREEYDVLDKRRGR<br>DPEMGGKPRRKNPQEGLYNELQKDKMAEAYSEIGMKGERRRGKGHDGLYQGLSTATKDTYDALHM<br>QALPPR |
| 437 | DIQMTQSPSTLSASVGDRVTITCRASQSISSWLAWYQQKPGKAPKLLIYEASSLESGVPSRFSGS<br>GSGTEFTLTISSLQPDDFATYYCQQANSHPITFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSIEVMYPPPYLDNEKS |

-continued

| SEQ ID NO. | AMINO ACID SEQUENCE |
|---|---|
| | NGTIIHVKGKHLCPSPLFPGPSKPIYIWAPLAGTCGVLLLSLVITLYCTKKKYSSSVHDPNGEYM<br>FMRAVNTAKKSRLTDVTLRVKFSRSADAPAYQQGQNQLYNELNLGRREEYDVLDKRRGRDPEMGG<br>KPRRKNPQEGLYNELQKDKMAEAYSEIGMKGERRRGKGHDGLYQGLSTATKDTYDALHMQALPPR |
| 438 | DIQMTQSPSTLSASVGDRVTITCRASQSISSWLAWYQQKPGKAPKLLIYEASSLESGVPSRFSGS<br>GSGTEFTLTISSLQPDDFATYYCQQANSHPITFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSIEVMYPPPYLDNEKS<br>NGTIIHVKGKHLCPSPLFPGPSKPFWVLVVVGGVLACYSLLVTVAFIIFWVKRGRKKLLYIFKQP<br>FMRPVQTTQEEDGCSCRFPEEEEGGCELRVKFSRSADAPAYQQGQNQLYNELNLGRREEYDVLDK<br>RRGRDPEMGGKPRRKNPQEGLYNELQKDKMAEAYSEIGMKGERRRGKGHDGLYQGLSTATKDTYD<br>ALHMQALPPR |
| 439 | DIQMTQSPSTLSASVGDRVTITCRASQSISSWLAWYQQKPGKAPKLLIYEASSLESGVPSRFSGS<br>GSGTEFTLTISSLQPDDFATYYCQQANSHPITFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSIEVMYPPPYLDNEKS<br>NGTIIHVKGKHLCPSPLFPGPSKPFWVLVVVGGVLACYSLLVTVAFIIFWVRSKRSRLLHSDYMN<br>MTPRRPGPTRKHYQPYAPPRDFAAYRSRVKFSRSADAPAYQQGQNQLYNELNLGRREEYDVLDKR<br>RGRDPEMGGKPRRKNPQEGLYNELQKDKMAEAYSEIGMKGERRRGKGHDGLYQGLSTATKDTYDA<br>LHMQALPPR |
| 440 | DIQMTQSPSTLSASVGDRVTITCRASQSISSWLAWYQQKPGKAPKLLIYEASSLESGVPSRFSGS<br>GSGTEFTLTISSLQPDDFATYYCQQANSHPITFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSIEVMYPPPYLDNEKS<br>NGTIIHVKGKHLCPSPLFPGPSKPFWVLVVVGGVLACYSLLVTVAFIIFWVTKKKYSSSVHDPNG<br>EYMEMRAVNTAKKSRLTDVTLRVKFSRSADAPAYQQGQNQLYNELNLGRREEYDVLDKRRGRDPE<br>MGGKPRRKNPQEGLYNELQKDKMAEAYSEIGMKGERRRGKGHDGLYQGLSTATKDTYDALHMQAL<br>PPR |
| 441 | DIQMTQSPSTLSASVGDRVTITCRASQSISSWLAWYQQKPGKAPKLLIYEASSLESGVPSRFSGS<br>GSGTEFTLTISSLQPDDFATYYCQQANSHPITFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSESKYGPPCPPCPIYI<br>WAPLAGTCGVLLLSLVITLYCKRGRKKLLYIFKQPEMRPVQTTQEEDGCSCRFPEEEEGGCELRV<br>KFSRSADAPAYQQGQNQLYNELNLGRREEYDVLDKRRGRDPEMGGKPRRKNPQEGLYNELQKDKM<br>AEAYSEIGMKGERRRGKGHDGLYQGLSTATKDTYDALHMQALPPR |
| 442 | DIQMTQSPSTLSASVGDRVTITCRASQSISSWLAWYQQKPGKAPKLLIYEASSLESGVPSRFSGS<br>GSGTEFTLTISSLQPDDFATYYCQQANSHPITFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSESKYGPPCPPCPIYI<br>WAPLAGTCGVLLLSLVITLYCRSKRSRLLHSDYMNMTPRRPGPTRKHYQPYAPPRDFAAYRSRVK<br>FSRSADAPAYQQGQNQLYNELNLGRREEYDVLDKRRGRDPEMGGKPRRKNPQEGLYNELQKDKMA<br>EAYSEIGMKGERRRGKGHDGLYQGLSTATKDTYDALHMQALPPR |
| 443 | DIQMTQSPSTLSASVGDRVTITCRASQSISSWLAWYQQKPGKAPKLLIYEASSLESGVPSRFSGS<br>GSGTEFTLTISSLQPDDFATYYCQQANSHPITFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSESKYGPPCPPCPIYI<br>WAPLAGTCGVLLLSLVITLYCTKKKYSSSVHDPNGEYMFMRAVNTAKKSRLTDVTLRVKFSRSAD<br>APAYQQGQNQLYNELNLGRREEYDVLDKRRGRDPEMGGKPRRKNPQEGLYNELQKDKMAEAYSEI<br>GMKGERRRGKGHDGLYQGLSTATKDTYDALHMQALPPR |
| 444 | DIQMTQSPSTLSASVGDRVTITCRASQSISSWLAWYQQKPGKAPKLLIYEASSLESGVPSRFSGS<br>GSGTEFTLTISSLQPDDFATYYCQQANSHPITFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSESKYGPPCPPCPFWV<br>LVVVGGVLACYSLLVTVAFIIFWVKRGRKKLLYIFKQPFMRPVQTTQEEDGCSCRFPEEEEGGCE<br>LRVKFSRSADAPAYQQGQNQLYNELNLGRREEYDVLDKRRGRDPEMGGKPRRKNPQEGLYNELQK<br>DKMAEAYSEIGMKGERRRGKGHDGLYQGLSTATKDTYDALHMQALPPR |
| 445 | DIQMTQSPSTLSASVGDRVTITCRASQSISSWLAWYQQKPGKAPKLLIYEASSLESGVPSRFSGS<br>GSGTEFTLTISSLQPDDFATYYCQQANSHPITFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSESKYGPPCPPCPFWV<br>LVVVGGVLACYSLLVTVAFIIFWVRSKRSRLLHSDYMNMTPRRPGPTRKHYQPYAPPRDFAAYRS<br>RVKFSRSADAPAYQQGQNQLYNELNLGRREEYDVLDKRRGRDPEMGGKPRRKNPQEGLYNELQKD<br>KMAEAYSEIGMKGERRRGKGHDGLYQGLSTATKDTYDALHMQALPPR |
| 446 | DIQMTQSPSTLSASVGDRVTITCRASQSISSWLAWYQQKPGKAPKLLIYEASSLESGVPSRFSGS<br>GSGTEFTLTISSLQPDDFATYYCQQANSHPITFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSESKYGPPCPPCPFWV<br>LVVVGGVLACYSLLVTVAFIIFWVTKKKYSSSVHDPNGEYMFMRAVNTAKKSRLTDVTLRVKFSR |

-continued

| SEQ ID NO. | AMINO ACID SEQUENCE |
|---|---|
| | SADAPAYQQGQNQLYNELNLGRREEYDVLDKRRGRDPEMGGKPRRKNPQEGLYNELQKDKMAEAY<br>SEIGMKGERRRGKGHDGLYQGLSTATKDTYDALHMQALPPR |
| 447 | DIQMTQSPSTLSASVGDRVTITCRASQSISSWLAWYQQKPGKAPKLLIYEASSLESGVPSRFSGS<br>GSGTEFTLTISSLQPDDFATYYCQQANSHPITFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSLEPKSCDKTHTCPPC<br>PIYIWAPLAGTCGVLLLSLVITLYCKRGRKKLLYIFKQPFMRPVQTTQEEDGCSCRFPEEEEGGC<br>ELRVKFSRSADAPAYQQGQNQLYNELNLGRREEYDVLDKRRGRDPEMGGKPRRKNPQEGLYNELQ<br>KDKMAEAYSEIGMKGERRRGKGHDGLYQGLSTATKDTYDALHMQALPPR |
| 448 | DIQMTQSPSTLSASVGDRVTITCRASQSISSWLAWYQQKPGKAPKLLIYEASSLESGVPSRFSGS<br>GSGTEFTLTISSLQPDDFATYYCQQANSHPITFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSLEPKSCDKTHTCPPC<br>PIYIWAPLAGTCGVLLLSLVITLYCRSKRSRLLHSDYMNMTPRRPGPTRKHYQPYAPPRDFAAYR<br>SRVKFSRSADAPAYQQGQNQLYNELNLGRREEYDVLDKRRGRDPEMGGKPRRKNPQEGLYNELQK<br>DKMAEAYSEIGMKGERRRGKGHDGLYQGLSTATKDTYDALHMQALPPR |
| 449 | DIQMTQSPSTLSASVGDRVTITCRASQSISSWLAWYQQKPGKAPKLLIYEASSLESGVPSRFSGS<br>GSGTEFTLTISSLQPDDFATYYCQQANSHPITFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSLEPKSCDKTHTCPPC<br>PIYIWAPLAGTCGVLLLSLVITLYCTKKKYSSSVHDPNGEYMFMRAVNTAKKSRLTDVTLRVKFS<br>RSADAPAYQQGQNQLYNELNLGRREEYDVLDKRRGRDPEMGGKPRRKNPQEGLYNELQKDKMAEA<br>YSEIGMKGERRRGKGHDGLYQGLSTATKDTYDALHMQALPPR |
| 450 | DIQMTQSPSTLSASVGDRVTITCRASQSISSWLAWYQQKPGKAPKLLIYEASSLESGVPSRFSGS<br>GSGTEFTLTISSLQPDDFATYYCQQANSHPITFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSLEPKSCDKTHTCPPC<br>PFWVLVVVGGVLACYSLLVTVAFIIFWVKRGRKKLLYIFKQPFMRPVQTTQEEDGCSCRFPEEEE<br>GGCELRVKFSRSADAPAYQQGQNQLYNELNLGRREEYDVLDKRRGRDPEMGGKPRRKNPQEGLYN<br>ELQKDKMAEAYSEIGMKGERRRGKGHDGLYQGLSTATKDTYDALHMQALPPR |
| 451 | DIQMTQSPSTLSASVGDRVTITCRASQSISSWLAWYQQKPGKAPKLLIYEASSLESGVPSRFSGS<br>GSGTEFTLTISSLQPDDFATYYCQQANSHPITFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSLEPKSCDKTHTCPPC<br>PFWVLVVVGGVLACYSLLVTVAFIIFWVRSKRSRLLHSDYMNMTPRRPGPTRKHYQPYAPPRDFA<br>AYRSRVKFSRSADAPAYQQGQNQLYNELNLGRREEYDVLDKRRGRDPEMGGKPRRKNPQEGLYNE<br>LQKDKMAEAYSEIGMKGERRRGKGHDGLYQGLSTATKDTYDALHMQALPPR |
| 452 | DIQMTQSPSTLSASVGDRVTITCRASQSISSWLAWYQQKPGKAPKLLIYEASSLESGVPSRFSGS<br>GSGTEFTLTISSLQPDDFATYYCQQANSHPITFGGGTKVEIKGGGGSGGGGSGGGGSGGGGSEVQ<br>LVESGGGLVKPGGSLRLSCAASGFTFSDYYMSWIRQAPGKGLEWVSYISSSGSTIYYADSVKGRF<br>TISRDNAKNSLYLQMNSLRAEDTAVYYCARDQGNYGVDVWGQGTTVTVSSLEPKSCDKTHTCPPC<br>PFWVLVVVGGVLACYSLLVTVAFIIFWVTKKKYSSSVHDPNGEYMFMRAVNTAKKSRLTDVTLRV<br>KFSRSADAPAYQQGQNQLYNELNLGRREEYDVLDKRRGRDPEMGGKPRRKNPQEGLYNELQKDKM<br>AEAYSEIGMKGERRRGKGHDGLYQGLSTATKDTYDALHMQALPPR |

In particular embodiments, a CAR comprises an antibody or antigen binding fragment thereof comprising an amino acid sequence set forth in SEQ ID NO: 79 or SEQ ID NO: 80; a spacer domain comprising an amino acid sequence set forth in SEQ ID NO: 145, SEQ ID NO: 146, SEQ ID NO: 148, or SEQ ID NO: 150; a transmembrane domain comprising an amino acid sequence set forth in SEQ ID NO: 151 or SEQ ID NO: 153; a costimulatory domain comprising an amino acid sequence set forth in SEQ ID NO: 159, SEQ ID NO: 160, or SEQ ID NO: 162; and a primary signaling domain comprising an amino acid sequence set forth in SEQ ID NO: 158. In particular embodiments, a CAR comprises an amino acid sequence set forth in any one of SEQ ID NOs: 453, 454, 455, 456, 457, 458, 459, 460, 461, 462, 463, 464, 465, 466, 467, 468, 469, 470, 471, 472, 473, 474, 475, and 476. In particular embodiments, a CAR comprises an amino acid sequence set forth in any one of SEQ ID NOs: 477, 478, 479, 480, 481, 482, 483, 484, 485, 486, 487, 488, 489, 490, 491, 492, 493, 494, 495, 496, 497, 498, 499, and 500.

| SEQ ID NO. | AMINO ACID SEQUENCE |
|---|---|
| 453 | EVQLLESGGGLVQPGGSLRLSCAASGFTFSNYAMSWVRQAPGKGLEWVSAISGSGGSTYYADSVK<br>GRFTISRDNSKNTLYLQMNSLRAEDTAVYYCARPGDGYYEGVYFDYWGQGTLVTVSSGGGGSGGG<br>GSGGGGSGGGGSDIQMTQSPSSLSASVGDRVTITCRASQSISSYLNWYQQKPGKAPKLLIYAASS<br>LQSGVPSRFSGSGSGTDFTLTISSLQPEDFATYYCQQAHSSPITFGGGTKVEIKTTTPAPRPPTP<br>APTIASQPLSLRPEACRPAAGGAVHTRGLDFACDIYIWAPLAGTCGVLLLSLVITLYCKRGRKKL<br>LYIFKQPFMRPVQTTQEEDGCSCRFPEEEEGGCELRVKFSRSADAPAYQQGQNQLYNELNLGRRE |

-continued

| SEQ ID NO. | AMINO ACID SEQUENCE |
|---|---|
| | EYDVLDKRRGRDPEMGGKPRRKNPQEGLYNELQKDKMAEAYSEIGMKGERRRGKGHDGLYQGLST ATKDTYDALHMQALPPR |
| 454 | EVQLLESGGGLVQPGGSLRLSCAASGFTFSNYAMSWVRQAPGKGLEWVSAISGSGGSTYYADSVK GRFTISRDNSKNTLYLQMNSLRAEDTAVYYCARPGDGYYEGVYFDYWGQGTLVTVSSGGGGSGGG GSGGGGSGGGGSDIQMTQSPSSLSASVGDRVTITCRASQSISSYLNWYQQKPGKAPKLLIYAASS LQSGVPSRFSGSGSGTDFTLTISSLQPEDFATYYCQQAHSSPITFGGGTKVEIKTTTPAPRPPTP APTIASQPLSLRPEACRPAAGGAVHTRGLDFACDIYIWAPLAGTCGVLLLSLVITLYCRSKRSRL LHSDYMNMTPRRPGPTRKHYQPYAPPRDFAAYRSRVKFSRSADAPAYQQGQNQLYNELNLGRREE YDVLDKRRGRDPEMGGKPRRKNPQEGLYNELQKDKMAEAYSEIGMKGERRRGKGHDGLYQGLSTA TKDTYDALHMQALPPR |
| 455 | EVQLLESGGGLVQPGGSLRLSCAASGFTFSNYAMSWVRQAPGKGLEWVSAISGSGGSTYYADSVK GRFTISRDNSKNTLYLQMNSLRAEDTAVYYCARPGDGYYEGVYFDYWGQGTLVTVSSGGGGSGGG GSGGGGGGGGSDIQMTQSPSSLSASVGDRVTITCRASQSISSYLNWYQQKPGKAPKLLIYAASS LQSGVPSRFSGSGSGTDFTLTISSLQPEDFATYYCQQAHSSPITFGGGTKVEIKTTTPAPRPPTP APTIASQPLSLRPEACRPAAGGAVHTRGLDFACDIYIWAPLAGTCGVLLLSLVITLYCTKKKYSS SVHDPNGEYMEMRAVNTAKKSRLTDVTLRVKFSRSADAPAYQQGQNQLYNELNLGRREEYDVLDK RRGRDPEMGGKPRRKNPQEGLYNELQKDKMAEAYSEIGMKGERRRGKGHDGLYQGLSTATKDTYD ALHMQALPPR |
| 456 | EVQLLESGGGLVQPGGSLRLSCAASGFTFSNYAMSWVRQAPGKGLEWVSAISGSGGSTYYADSVK GRFTISRDNSKNTLYLQMNSLRAEDTAVYYCARPGDGYYEGVYFDYWGQGTLVTVSSGGGGSGGG GSGGGGSGGGGSDIQMTQSPSSLSASVGDRVTITCRASQSISSYLNWYQQKPGKAPKLLIYAASS LQSGVPSRFSGSGSGTDFTLTISSLQPEDFATYYCQQAHSSPITFGGGTKVEIKTTTPAPRPPTP APTIASQPLSLRPEACRPAAGGAVHTRGLDFACDFWVLVVVGGVLACYSLLVTVAFIIFWVKRGR KKLLYIFKQPFMRPVQTTQEEDGCSCRFPEEEEGGCELRVKFSRSADAPAYQQGQNQLYNELNLG RREEYDVLDKRRGRDPEMGGKPRRKNPQEGLYNELQKDKMAEAYSEIGMKGERRRGKGHDGLYQG LSTATKDTYDALHMQALPPR |
| 457 | EVQLLESGGGLVQPGGSLRLSCAASGFTFSNYAMSWVRQAPGKGLEWVSAISGSGGSTYYADSVK GRFTISRDNSKNTLYLQMNSLRAEDTAVYYCARPGDGYYEGVYFDYWGQGTLVTVSSGGGGSGGG GSGGGGSGGGGSDIQMTQSPSSLSASVGDRVTITCRASQSISSYLNWYQQKPGKAPKLLIYAASS LQSGVPSRFSGSGSGTDFTLTISSLQPEDFATYYCQQAHSSPITFGGGTKVEIKTTTPAPRPPTP APTIASQPLSLRPEACRPAAGGAVHTRGLDFACDFWVLVVVGGVLACYSLLVTVAFIIFWVRSKR SRLLHSDYMNMTPRRPGPTRKHYQPYAPPRDFAAYRSRVKFSRSADAPAYQQGQNQLYNELNLGR REEYDVLDKRRGRDPEMGGKPRRKNPQEGLYNELQKDKMAEAYSEIGMKGERRRGKGHDGLYQGL STATKDTYDALHMQALPPR |
| 458 | EVQLLESGGGLVQPGGSLRLSCAASGFTFSNYAMSWVRQAPGKGLEWVSAISGSGGSTYYADSVK GRFTISRDNSKNTLYLQMNSLRAEDTAVYYCARPGDGYYEGVYFDYWGQGTLVTVSSGGGGSGGG GSGGGGSGGGGSDIQMTQSPSSLSASVGDRVTITCRASQSISSYLNWYQQKPGKAPKLLIYAASS LQSGVPSRFSGSGSGTDFTLTISSLQPEDFATYYCQQAHSSPITFGGGTKVEIKTTTPAPRPPTP APTIASQPLSLRPEACRPAAGGAVHTRGLDFACDFWVLVVVGGVLACYSLLVTVAFIIFWVTKKK YSSSVHDPNGEYMFMRAVNTAKKSRLTDVTLRVKFSRSADAPAYQQGQNQLYNELNLGRREEYDV LDKRRGRDPEMGGKPRRKNPQEGLYNELQKDKMAEAYSEIGMKGERRRGKGHDGLYQGLSTATKD TYDALHMQALPPR |
| 459 | EVQLLESGGGLVQPGGSLRLSCAASGFTFSNYAMSWVRQAPGKGLEWVSAISGSGGSTYYADSVK GRFTISRDNSKNTLYLQMNSLRAEDTAVYYCARPGDGYYEGVYFDYWGQGTLVTVSSGGGGSGGG GSGGGGSGGGGSDIQMTQSPSSLSASVGDRVTITCRASQSISSYLNWYQQKPGKAPKLLIYAASS LQSGVPSRFSGSGSGTDFTLTISSLQPEDFATYYCQQAHSSPITFGGGTKVEIKIEVMYPPPYLD NEKSNGTIIHVKGKHLCPSPLFPGPSKPIYIWAPLAGTCGVLLLSLVITLYCKRGRKKLLYIFKQ PFMRPVQTTQEEDGCSCRFPEEEEGGCELRVKFSRSADAPAYQQGQNQLYNELNLGRREEYDVLD KRRGRDPEMGGKPRRKNPQEGLYNELQKDKMAEAYSEIGMKGERRRGKGHDGLYQGLSTATKDTY DALHMQALPPR |
| 460 | EVQLLESGGGLVQPGGSLRLSCAASGFTFSNYAMSWVRQAPGKGLEWVSAISGSGGSTYYADSVK GRFTISRDNSKNTLYLQMNSLRAEDTAVYYCARPGDGYYEGVYFDYWGQGTLVTVSSGGGGSGGG GSGGGGSGGGGSDIQMTQSPSSLSASVGDRVTITCRASQSISSYLNWYQQKPGKAPKLLIYAASS LQSGVPSRFSGSGSGTDFTLTISSLQPEDFATYYCQQAHSSPITFGGGTKVEIKIEVMYPPPYLD NEKSNGTIIHVKGKHLCPSPLFPGPSKPIYIWAPLAGTCGVLLLSLVITLYCRSKRSRLLHSDYM NMTPRRPGPTRKHYQPYAPPRDFAAYRSRVKFSRSADAPAYQQGQNQLYNELNLGRREEYDVLDK RRGRDPEMGGKPRRKNPQEGLYNELQKDKMAEAYSEIGMKGERRRGKGHDGLYQGLSTATKDTYD ALHMQALPPR |
| 461 | EVQLLESGGGLVQPGGSLRLSCAASGFTFSNYAMSWVRQAPGKGLEWVSAISGSGGSTYYADSVK GRFTISRDNSKNTLYLQMNSLRAEDTAVYYCARPGDGYYEGVYFDYWGQGTLVTVSSGGGGSGGG GSGGGGSGGGGSDIQMTQSPSSLSASVGDRVTITCRASQSISSYLNWYQQKPGKAPKLLIYAASS LQSGVPSRFSGSGSGTDFTLTISSLQPEDFATYYCQQAHSSPITFGGGTKVEIKIEVMYPPPYLD NEKSNGTIIHVKGKHLCPSPLFPGPSKPIYIWAPLAGTCGVLLLSLVITLYCTKKKYSSSVHDPN GEYMFMRAVNTAKKSRLTDVTLRVKFSRSADAPAYQQGQNQLYNELNLGRREEYDVLDKRRGRDP EMGGKPRRKNPQEGLYNELQKDKMAEAYSEIGMKGERRRGKGHDGLYQGLSTATKDTYDALHMQA LPPR |

-continued

| SEQ ID NO. | AMINO ACID SEQUENCE |
|---|---|
| 462 | EVQLLESGGGLVQPGGSLRLSCAASGFTFSNYAMSWVRQAPGKGLEWVSAISGSGGSTYYADSVK<br>GRFTISRDNSKNTLYLQMNSLRAEDTAVYYCARPGDGYYEGVYFDYWGQGTLVTVSSGGGGSGGG<br>GSGGGGSGGGGSDIQMTQSPSSLSASVGDRVTITCRASQSISSYLNWYQQKPGKAPKLLIYAASS<br>LQSGVPSRFSGSGSGTDFTLTISSLQPEDFATYYCQQAHSSPITFGGGTKVEIKIEVMYPPPYLD<br>NEKSNGTIIHVKGKHLCPSPLFPGPSKPFWVLVVVGGVLACYSLLVTVAFIIFWVKRGRKKLLYI<br>FKQPFMRPVQTTQEEDGCSCRFPEEEEGGCELRVKFSRSADAPAYQQGQNQLYNELNLGRREEYD<br>VLDKRRGRDPEMGGKPRRKNPQEGLYNELQKDKMAEAYSEIGMKGERRRGKGHDGLYQGLSTATK<br>DTYDALHMQALPPR |
| 463 | EVQLLESGGGLVQPGGSLRLSCAASGFTFSNYAMSWVRQAPGKGLEWVSAISGSGGSTYYADSVK<br>GRFTISRDNSKNTLYLQMNSLRAEDTAVYYCARPGDGYYEGVYFDYWGQGTLVTVSSGGGGSGGG<br>GSGGGGSGGGGSDIQMTQSPSSLSASVGDRVTITCRASQSISSYLNWYQQKPGKAPKLLIYAASS<br>LQSGVPSRFSGSGSGTDFTLTISSLQPEDFATYYCQQAHSSPITFGGGTKVEIKIEVMYPPPYLD<br>NEKSNGTIIHVKGKHLCPSPLFPGPSKPFWVLVVVGGVLACYSLLVTVAFIIFWVRSKRSRLLHS<br>DYMNMTPRRPGPTRKHYQPYAPPRDFAAYRSRVKFSRSADAPAYQQGQNQLYNELNLGRREEYDV<br>LDKRRGRDPEMGGKPRRKNPQEGLYNELQKDKMAEAYSEIGMKGERRRGKGHDGLYQGLSTATKD<br>TYDALHMQALPPR |
| 464 | EVQLLESGGGLVQPGGSLRLSCAASGFTFSNYAMSWVRQAPGKGLEWVSAISGSGGSTYYADSVK<br>GRFTISRDNSKNTLYLQMNSLRAEDTAVYYCARPGDGYYEGVYFDYWGQGTLVTVSSGGGGSGGG<br>GSGGGGSGGGGSDIQMTQSPSSLSASVGDRVTITCRASQSISSYLNWYQQKPGKAPKLLIYAASS<br>LQSGVPSRFSGSGSGTDFTLTISSLQPEDFATYYCQQAHSSPITFGGGTKVEIKIEVMYPPPYLD<br>NEKSNGTIIHVKGKHLCPSPLFPGPSKPFWVLVVVGGVLACYSLLVTVAFIIFWVTKKKYSSSVH<br>DPNGEYMEMRAVNTAKKSRLTDVTLRVKFSRSADAPAYQQGQNQLYNELNLGRREEYDVLDKRRG<br>RDPEMGGKPRRKNPQEGLYNELQKDKMAEAYSEIGMKGERRRGKGHDGLYQGLSTATKDTYDALH<br>MQALPPR |
| 465 | EVQLLESGGGLVQPGGSLRLSCAASGFTFSNYAMSWVRQAPGKGLEWVSAISGSGGSTYYADSVK<br>GRFTISRDNSKNTLYLQMNSLRAEDTAVYYCARPGDGYYEGVYFDYWGQGTLVTVSSGGGGSGGG<br>GSGGGGSGGGGSDIQMTQSPSSLSASVGDRVTITCRASQSISSYLNWYQQKPGKAPKLLIYAASS<br>LQSGVPSRFSGSGSGTDFTLTISSLQPEDFATYYCQQAHSSPITFGGGTKVEIKESKYGPPCPPC<br>PIYIWAPLAGTCGVLLLSLVITLYCKRGRKKLLYIFKQPFMRPVQTTQEEDGCSCRFPEEEEGGC<br>ELRVKFSRSADAPAYQQGQNQLYNELNLGRREEYDVLDKRRGRDPEMGGKPRRKNPQEGLYNELQ<br>KDKMAEAYSEIGMKGERRRGKGHDGLYQGLSTATKDTYDALHMQALPPR |
| 466 | EVQLLESGGGLVQPGGSLRLSCAASGFTFSNYAMSWVRQAPGKGLEWVSAISGSGGSTYYADSVK<br>GRFTISRDNSKNTLYLQMNSLRAEDTAVYYCARPGDGYYEGVYFDYWGQGTLVTVSSGGGGSGGG<br>GSGGGGSGGGGSDIQMTQSPSSLSASVGDRVTITCRASQSISSYLNWYQQKPGKAPKLLIYAASS<br>LQSGVPSRFSGSGSGTDFTLTISSLQPEDFATYYCQQAHSSPITFGGGTKVEIKESKYGPPCPPC<br>PIYIWAPLAGTCGVLLLSLVITLYCRSKRSRLLHSDYMNMTPRRPGPTRKHYQPYAPPRDFAAYR<br>SRVKFSRSADAPAYQQGQNQLYNELNLGRREEYDVLDKRRGRDPEMGGKPRRKNPQEGLYNELQK<br>DKMAEAYSEIGMKGERRRGKGHDGLYQGLSTATKDTYDALHMQALPPR |
| 467 | EVQLLESGGGLVQPGGSLRLSCAASGFTFSNYAMSWVRQAPGKGLEWVSAISGSGGSTYYADSVK<br>GRFTISRDNSKNTLYLQMNSLRAEDTAVYYCARPGDGYYEGVYFDYWGQGTLVTVSSGGGGSGGG<br>GSGGGGSGGGGSDIQMTQSPSSLSASVGDRVTITCRASQSISSYLNWYQQKPGKAPKLLIYAASS<br>LQSGVPSRFSGSGSGTDFTLTISSLQPEDFATYYCQQAHSSPITFGGGTKVEIKESKYGPPCPPC<br>PIYIWAPLAGTCGVLLLSLVITLYCTKKKYSSSVHDPNGEYMEMRAVNTAKKSRLTDVTLRVKES<br>RSADAPAYQQGQNQLYNELNLGRREEYDVLDKRRGRDPEMGGKPRRKNPQEGLYNELQKDKMAEA<br>YSEIGMKGERRRGKGHDGLYQGLSTATKDTYDALHMQALPPR |
| 468 | EVQLLESGGGLVQPGGSLRLSCAASGFTFSNYAMSWVRQAPGKGLEWVSAISGSGGSTYYADSVK<br>GRFTISRDNSKNTLYLQMNSLRAEDTAVYYCARPGDGYYEGVYFDYWGQGTLVTVSSGGGGSGGG<br>GSGGGGSGGGGSDIQMTQSPSSLSASVGDRVTITCRASQSISSYLNWYQQKPGKAPKLLIYAASS<br>LQSGVPSRFSGSGSGTDFTLTISSLQPEDFATYYCQQAHSSPITFGGGTKVEIKESKYGPPCPPC<br>PFWVLVVVGGVLACYSLLVTVAFIIFWVKRGRKKLLYIFKQPEMRPVQTTQEEDGCSCRFPEEEE<br>GGCELRVKFSRSADAPAYQQGQNQLYNELNLGRREEYDVLDKRRGRDPEMGGKPRRKNPQEGLYN<br>ELQKDKMAEAYSEIGMKGERRRGKGHDGLYQGLSTATKDTYDALHMQALPPR |
| 469 | EVQLLESGGGLVQPGGSLRLSCAASGFTFSNYAMSWVRQAPGKGLEWVSAISGSGGSTYYADSVK<br>GRFTISRDNSKNTLYLQMNSLRAEDTAVYYCARPGDGYYEGVYFDYWGQGTLVTVSSGGGGSGGG<br>GSGGGGSGGGGSDIQMTQSPSSLSASVGDRVTITCRASQSISSYLNWYQQKPGKAPKLLIYAASS<br>LQSGVPSRFSGSGSGTDFTLTISSLQPEDFATYYCQQAHSSPITFGGGTKVEIKESKYGPPCPPC<br>PFWVLVVVGGVLACYSLLVTVAFIIFWVRSKRSRLLHSDYMNMTPRRPGPTRKHYQPYAPPRDFA<br>AYRSRVKFSRSADAPAYQQGQNQLYNELNLGRREEYDVLDKRRGRDPEMGGKPRRKNPQEGLYNE<br>LQKDKMAEAYSEIGMKGERRRGKGHDGLYQGLSTATKDTYDALHMQALPPR |
| 470 | EVQLLESGGGLVQPGGSLRLSCAASGFTFSNYAMSWVRQAPGKGLEWVSAISGSGGSTYYADSVK<br>GRFTISRDNSKNTLYLQMNSLRAEDTAVYYCARPGDGYYEGVYFDYWGQGTLVTVSSGGGGSGGG<br>GSGGGGSGGGGSDIQMTQSPSSLSASVGDRVTITCRASQSISSYLNWYQQKPGKAPKLLIYAASS<br>LQSGVPSRFSGSGSGTDFTLTISSLQPEDFATYYCQQAHSSPITFGGGTKVEIKESKYGPPCPPC<br>PFWVLVVVGGVLACYSLLVTVAFIIFWVTKKKYSSSVHDPNGEYMFMRAVNTAKKSRLTDVTLRV<br>KFSRSADAPAYQQGQNQLYNELNLGRREEYDVLDKRRGRDPEMGGKPRRKNPQEGLYNELQKDKM<br>AEAYSEIGMKGERRRGKGHDGLYQGLSTATKDTYDALHMQALPPR |

-continued

| SEQ ID NO. | AMINO ACID SEQUENCE |
|---|---|
| 471 | EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 472 | EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKLEPKSCDKTHTCPPCPIYIWAPLAGTCGVLLLSLVITLYCRSKRSRLLHSDYMNMTPRRPGPTRKHYQPYAPPRDEAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 473 | EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKLEPKSCDKTHTCPPCPIYIWAPLAGTCGVLLLSLVITLYCTKKKYSSSVHDPNGEYMEMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 474 | EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKLEPKSCDKTHTCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 475 | EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKLEPKSCDKTHTCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 476 | EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKLEPKSCDKTHTCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 477 | DIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKGGGGSGGGGSGGGGGGGGSEVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 478 | DIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKGGGGSGGGGSGGGGSGGGGSEVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 479 | DIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKGGGGSGGGGSGGGGSGGGGSEVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSTTTPAPRPPTPAPTIASQPLSLRPEACRPAAGGAVHTRGLDFACDIYIWAPLAGTCGVLLLSLVITLYCTKKKYSSSVHDPNGEYMEMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |

-continued

| SEQ ID NO. | AMINO ACID SEQUENCE |
|---|---|
| 480 | DIQMTQSPSSLSASVGDRVTITCRASQSISSYLNWYQQKPGKAPKLLIYAASSLQSGVPSRFSGS<br>GSGTDFTLTISSLQPEDFATYYCQQAHSSPITFGGGTKVEIKGGGGSGGGGSGGGGSGGGGSEVQ<br>LLESGGGLVQPGGSLRLSCAASGFTFSNYAMSWVRQAPGKGLEWVSAISGSGGSTYYADSVKGRF<br>TISRDNSKNTLYLQMNSLRAEDTAVYYCARPGDGYYEGVYFDYWGQGTLVTVSSTTTPAPRPPTP<br>APTIASQPLSLRPEACRPAAGGAVHTRGLDFACDFWVLVVVGGVLACYSLLVTVAFIIFWVKRGR<br>KKLLYIFKQPFMRPVQTTQEEDGCSCRFPEEEEGGCELRVKESRSADAPAYQQGQNQLYNELNLG<br>RREEYDVLDKRRGRDPEMGGKPRRKNPQEGLYNELQKDKMAEAYSEIGMKGERRRGKGHDGLYQG<br>LSTATKDTYDALHMQALPPR |
| 481 | DIQMTQSPSSLSASVGDRVTITCRASQSISSYLNWYQQKPGKAPKLLIYAASSLQSGVPSRFSGS<br>GSGTDFTLTISSLQPEDFATYYCQQAHSSPITFGGGTKVEIKGGGGSGGGGSGGGGSGGGGSEVQ<br>LLESGGGLVQPGGSLRLSCAASGFTFSNYAMSWVRQAPGKGLEWVSAISGSGGSTYYADSVKGRF<br>TISRDNSKNTLYLQMNSLRAEDTAVYYCARPGDGYYEGVYFDYWGQGTLVTVSSTTTPAPRPPTP<br>APTIASQPLSLRPEACRPAAGGAVHTRGLDFACDFWVLVVVGGVLACYSLLVTVAFIIFWVRSKR<br>SRLLHSDYMNMTPRRPGPTRKHYQPYAPPRDFAAYRSRVKFSRSADAPAYQQGQNQLYNELNLGR<br>REEYDVLDKRRGRDPEMGGKPRRKNPQEGLYNELQKDKMAEAYSEIGMKGERRRGKGHDGLYQGL<br>STATKDTYDALHMQALPPR |
| 482 | DIQMTQSPSSLSASVGDRVTITCRASQSISSYLNWYQQKPGKAPKLLIYAASSLQSGVPSRFSGS<br>GSGTDFTLTISSLQPEDFATYYCQQAHSSPITFGGGTKVEIKGGGGSGGGGSGGGGSGGGGSEVQ<br>LLESGGGLVQPGGSLRLSCAASGFTFSNYAMSWVRQAPGKGLEWVSAISGSGGSTYYADSVKGRF<br>TISRDNSKNTLYLQMNSLRAEDTAVYYCARPGDGYYEGVYFDYWGQGTLVTVSSTTTPAPRPPTP<br>APTIASQPLSLRPEACRPAAGGAVHTRGLDFACDFWVLVVVGGVLACYSLLVTVAFIIFWVTKKK<br>YSSSVHDPNGEYMFMRAVNTAKKSRLTDVTLRVKFSRSADAPAYQQGQNQLYNELNLGRREEYDV<br>LDKRRGRDPEMGGKPRRKNPQEGLYNELQKDKMAEAYSEIGMKGERRRGKGHDGLYQGLSTATKD<br>TYDALHMQALPPR |
| 483 | DIQMTQSPSSLSASVGDRVTITCRASQSISSYLNWYQQKPGKAPKLLIYAASSLQSGVPSRESGS<br>GSGTDFTLTISSLQPEDFATYYCQQAHSSPITFGGGTKVEIKGGGGSGGGGSGGGGSGGGGSEVQ<br>LLESGGGLVQPGGSLRLSCAASGFTFSNYAMSWVRQAPGKGLEWVSAISGSGGSTYYADSVKGRF<br>TISRDNSKNTLYLQMNSLRAEDTAVYYCARPGDGYYEGVYFDYWGQGTLVTVSSIEVMYPPPYLD<br>NEKSNGTIIHVKGKHLCPSPLFPGPSKPIYIWAPLAGTCGVLLLSLVITLYCKRGRKKLLYIFKQ<br>PFMRPVQTTQEEDGCSCRFPEEEEGGCELRVKFSRSADAPAYQQGQNQLYNELNLGRREEYDVLD<br>KRRGRDPEMGGKPRRKNPQEGLYNELQKDKMAEAYSEIGMKGERRRGKGHDGLYQGLSTATKDTY<br>DALHMQALPPR |
| 484 | DIQMTQSPSSLSASVGDRVTITCRASQSISSYLNWYQQKPGKAPKLLIYAASSLQSGVPSRFSGS<br>GSGTDFTLTISSLQPEDFATYYCQQAHSSPITFGGGTKVEIKGGGGSGGGGSGGGGSGGGGSEVQ<br>LLESGGGLVQPGGSLRLSCAASGFTFSNYAMSWVRQAPGKGLEWVSAISGSGGSTYYADSVKGRF<br>TISRDNSKNTLYLQMNSLRAEDTAVYYCARPGDGYYEGVYFDYWGQGTLVTVSSIEVMYPPPYLD<br>NEKSNGTIIHVKGKHLCPSPLFPGPSKPIYIWAPLAGTCGVLLLSLVITLYCRSKRSRLLHSDYM<br>NMTPRRPGPTRKHYQPYAPPRDFAAYRSRVKFSRSADAPAYQQGQNQLYNELNLGRREEYDVLDK<br>RRGRDPEMGGKPRRKNPQEGLYNELQKDKMAEAYSEIGMKGERRRGKGHDGLYQGLSTATKDTYD<br>ALHMQALPPR |
| 485 | DIQMTQSPSSLSASVGDRVTITCRASQSISSYLNWYQQKPGKAPKLLIYAASSLQSGVPSRFSGS<br>GSGTDFTLTISSLQPEDFATYYCQQAHSSPITFGGGTKVEIKGGGGSGGGGSGGGGSGGGGSEVQ<br>LLESGGGLVQPGGSLRLSCAASGFTFSNYAMSWVRQAPGKGLEWVSAISGSGGSTYYADSVKGRF<br>TISRDNSKNTLYLQMNSLRAEDTAVYYCARPGDGYYEGVYFDYWGQGTLVTVSSIEVMYPPPYLD<br>NEKSNGTIIHVKGKHLCPSPLFPGPSKPIYIWAPLAGTCGVLLLSLVITLYCTKKKYSSSVHDPN<br>GEYMEMRAVNTAKKSRLTDVTLRVKFSRSADAPAYQQGQNQLYNELNLGRREEYDVLDKRRGRDP<br>EMGGKPRRKNPQEGLYNELQKDKMAEAYSEIGMKGERRRGKGHDGLYQGLSTATKDTYDALHMQA<br>LPPR |
| 486 | DIQMTQSPSSLSASVGDRVTITCRASQSISSYLNWYQQKPGKAPKLLIYAASSLQSGVPSRFSGS<br>GSGTDFTLTISSLQPEDFATYYCQQAHSSPITFGGGTKVEIKGGGGSGGGGSGGGGSGGGGSEVQ<br>LLESGGGLVQPGGSLRLSCAASGFTFSNYAMSWVRQAPGKGLEWVSAISGSGGSTYYADSVKGRF<br>TISRDNSKNTLYLQMNSLRAEDTAVYYCARPGDGYYEGVYFDYWGQGTLVTVSSIEVMYPPPYLD<br>NEKSNGTIIHVKGKHLCPSPLFPGPSKPFWVLVVVGGVLACYSLLVTVAFIIFWVKRGRKKLLYI<br>FKQPFMRPVQTTQEEDGCSCRFPEEEEGGCELRVKFSRSADAPAYQQGQNQLYNELNLGRREEYD<br>VLDKRRGRDPEMGGKPRRKNPQEGLYNELQKDKMAEAYSEIGMKGERRRGKGHDGLYQGLSTATK<br>DTYDALHMQALPPR |
| 487 | DIQMTQSPSSLSASVGDRVTITCRASQSISSYLNWYQQKPGKAPKLLIYAASSLQSGVPSRFSGS<br>GSGTDFTLTISSLQPEDFATYYCQQAHSSPITFGGGTKVEIKGGGGSGGGGSGGGGSGGGGSEVQ<br>LLESGGGLVQPGGSLRLSCAASGFTFSNYAMSWVRQAPGKGLEWVSAISGSGGSTYYADSVKGRF<br>TISRDNSKNTLYLQMNSLRAEDTAVYYCARPGDGYYEGVYFDYWGQGTLVTVSSIEVMYPPPYLD<br>NEKSNGTIIHVKGKHLCPSPLFPGPSKPFWVLVVVGGVLACYSLLVTVAFIIFWVRSKRSRLLHS<br>DYMNMTPRRPGPTRKHYQPYAPPRDFAAYRSRVKFSRSADAPAYQQGQNQLYNELNLGRREEYDV<br>LDKRRGRDPEMGGKPRRKNPQEGLYNELQKDKMAEAYSEIGMKGERRRGKGHDGLYQGLSTATKD<br>TYDALHMQALPPR |
| 488 | DIQMTQSPSSLSASVGDRVTITCRASQSISSYLNWYQQKPGKAPKLLIYAASSLQSGVPSRFSGS<br>GSGTDFTLTISSLQPEDFATYYCQQAHSSPITFGGGTKVEIKGGGGSGGGGSGGGGSGGGGSEVQ<br>LLESGGGLVQPGGSLRLSCAASGFTFSNYAMSWVRQAPGKGLEWVSAISGSGGSTYYADSVKGRF |

-continued

| SEQ ID NO. | AMINO ACID SEQUENCE |
|---|---|
| | TISRDNSKNTLYLQMNSLRAEDTAVYYCARPGDGYYEGVYFDYWGQGTLVTVSSIEVMYPPPYLD<br>NEKSNGTIIHVKGKHLCPSPLFPGPSKPFWVLVVVGGVLACYSLLVTVAFIIFWVTKKKYSSSVH<br>DPNGEYMFMRAVNTAKKSRLTDVTLRVKFSRSADAPAYQQGQNQLYNELNLGRREEYDVLDKRRG<br>RDPEMGGKPRRKNPQEGLYNELQKDKMAEAYSEIGMKGERRRGKGHDGLYQGLSTATKDTYDALH<br>MQALPPR |
| 489 | DIQMTQSPSSLSASVGDRVTITCRASQSISSYLNWYQQKPGKAPKLLIYAASSLQSGVPSRESGS<br>GSGTDFTLTISSLQPEDFATYYCQQAHSSPITFGGGTKVEIKGGGGSGGGGSGGGGSGGGGSEVQ<br>LLESGGGLVQPGGSLRLSCAASGFTFSNYAMSWVRQAPGKGLEWVSAISGSGGSTYYADSVKGRF<br>TISRDNSKNTLYLQMNSLRAEDTAVYYCARPGDGYYEGVYFDYWGQGTLVTVSSESKYGPPCPPC<br>PIYIWAPLAGTCGVLLLSLVITLYCKRGRKKLLYIFKQPFMRPVQTTQEEDGCSCRFPEEEEGGC<br>ELRVKFSRSADAPAYQQGQNQLYNELNLGRREEYDVLDKRRGRDPEMGGKPRRKNPQEGLYNELQ<br>KDKMAEAYSEIGMKGERRRGKGHDGLYQGLSTATKDTYDALHMQALPPR |
| 490 | DIQMTQSPSSLSASVGDRVTITCRASQSISSYLNWYQQKPGKAPKLLIYAASSLQSGVPSRFSGS<br>GSGTDFTLTISSLQPEDFATYYCQQAHSSPITFGGGTKVEIKGGGGSGGGGSGGGGSGGGGSEVQ<br>LLESGGGLVQPGGSLRLSCAASGFTFSNYAMSWVRQAPGKGLEWVSAISGSGGSTYYADSVKGRF<br>TISRDNSKNTLYLQMNSLRAEDTAVYYCARPGDGYYEGVYFDYWGQGTLVTVSSESKYGPPCPPC<br>PIYIWAPLAGTCGVLLLSLVITLYCRSKRSRLLHSDYMNMTPRRPGPTRKHYQPYAPPRDFAAYR<br>SRVKFSRSADAPAYQQGQNQLYNELNLGRREEYDVLDKRRGRDPEMGGKPRRKNPQEGLYNELQK<br>DKMAEAYSEIGMKGERRRGKGHDGLYQGLSTATKDTYDALHMQALPPR |
| 491 | DIQMTQSPSSLSASVGDRVTITCRASQSISSYLNWYQQKPGKAPKLLIYAASSLQSGVPSRFSGS<br>GSGTDFTLTISSLQPEDFATYYCQQAHSSPITFGGGTKVEIKGGGGSGGGGSGGGGSGGGGSEVQ<br>LLESGGGLVQPGGSLRLSCAASGFTFSNYAMSWVRQAPGKGLEWVSAISGSGGSTYYADSVKGRF<br>TISRDNSKNTLYLQMNSLRAEDTAVYYCARPGDGYYEGVYFDYWGQGTLVTVSSESKYGPPCPPC<br>PIYIWAPLAGTCGVLLLSLVITLYCTKKKYSSSVHDPNGEYMFMRAVNTAKKSRLTDVTLRVKFS<br>RSADAPAYQQGQNQLYNELNLGRREEYDVLDKRRGRDPEMGGKPRRKNPQEGLYNELQKDKMAEA<br>YSEIGMKGERRRGKGHDGLYQGLSTATKDTYDALHMQALPPR |
| 492 | DIQMTQSPSSLSASVGDRVTITCRASQSISSYLNWYQQKPGKAPKLLIYAASSLQSGVPSRFSGS<br>GSGTDFTLTISSLQPEDFATYYCQQAHSSPITFGGGTKVEIKGGGGSGGGGSGGGGSGGGGSEVQ<br>LLESGGGLVQPGGSLRLSCAASGFTFSNYAMSWVRQAPGKGLEWVSAISGSGGSTYYADSVKGRF<br>TISRDNSKNTLYLQMNSLRAEDTAVYYCARPGDGYYEGVYFDYWGQGTLVTVSSESKYGPPCPPC<br>PFWVLVVVGGVLACYSLLVTVAFIIFWVKRGRKKLLYIFKQPFMRPVQTTQEEDGCSCRFPEEEE<br>GGCELRVKFSRSADAPAYQQGQNQLYNELNLGRREEYDVLDKRRGRDPEMGGKPRRKNPQEGLYN<br>ELQKDKMAEAYSEIGMKGERRRGKGHDGLYQGLSTATKDTYDALHMQALPPR |
| 493 | DIQMTQSPSSLSASVGDRVTITCRASQSISSYLNWYQQKPGKAPKLLIYAASSLQSGVPSRFSGS<br>GSGTDFTLTISSLQPEDFATYYCQQAHSSPITFGGGTKVEIKGGGGSGGGGSGGGGSGGGGSEVQ<br>LLESGGGLVQPGGSLRLSCAASGFTFSNYAMSWVRQAPGKGLEWVSAISGSGGSTYYADSVKGRF<br>TISRDNSKNTLYLQMNSLRAEDTAVYYCARPGDGYYEGVYFDYWGQGTLVTVSSESKYGPPCPPC<br>PFWVLVVVGGVLACYSLLVTVAFIIFWVRSKRSRLLHSDYMNMTPRRPGPTRKHYQPYAPPRDFA<br>AYRSRVKFSRSADAPAYQQGQNQLYNELNLGRREEYDVLDKRRGRDPEMGGKPRRKNPQEGLYNE<br>LQKDKMAEAYSEIGMKGERRRGKGHDGLYQGLSTATKDTYDALHMQALPPR |
| 494 | DIQMTQSPSSLSASVGDRVTITCRASQSISSYLNWYQQKPGKAPKLLIYAASSLQSGVPSRFSGS<br>GSGTDFTLTISSLQPEDFATYYCQQAHSSPITFGGGTKVEIKGGGGSGGGGSGGGGSGGGGSEVQ<br>LLESGGGLVQPGGSLRLSCAASGFTFSNYAMSWVRQAPGKGLEWVSAISGSGGSTYYADSVKGRF<br>TISRDNSKNTLYLQMNSLRAEDTAVYYCARPGDGYYEGVYFDYWGQGTLVTVSSESKYGPPCPPC<br>PFWVLVVVGGVLACYSLLVTVAFIIFWVTKKKYSSSVHDPNGEYMFMRAVNTAKKSRLTDVTLRV<br>KFSRSADAPAYQQGQNQLYNELNLGRREEYDVLDKRRGRDPEMGGKPRRKNPQEGLYNELQKDKM<br>AEAYSEIGMKGERRRGKGHDGLYQGLSTATKDTYDALHMQALPPR |
| 495 | DIQMTQSPSSLSASVGDRVTITCRASQSISSYLNWYQQKPGKAPKLLIYAASSLQSGVPSRESGS<br>GSGTDFTLTISSLQPEDFATYYCQQAHSSPITFGGGTKVEIKGGGGSGGGGSGGGGGGGGSEVQ<br>LLESGGGLVQPGGSLRLSCAASGFTFSNYAMSWVRQAPGKGLEWVSAISGSGGSTYYADSVKGRF<br>TISRDNSKNTLYLQMNSLRAEDTAVYYCARPGDGYYEGVYFDYWGQGTLVTVSSLEPKSCDKTHT<br>CPPCPIYIWAPLAGTCGVLLLSLVITLYCKRGRKKLLYIFKQPFMRPVQTTQEEDGCSCRFPEEE<br>EGGCELRVKFSRSADAPAYQQGQNQLYNELNLGRREEYDVLDKRRGRDPEMGGKPRRKNPQEGLY<br>NELQKDKMAEAYSEIGMKGERRRGKGHDGLYQGLSTATKDTYDALHMQALPPR |
| 496 | DIQMTQSPSSLSASVGDRVTITCRASQSISSYLNWYQQKPGKAPKLLIYAASSLQSGVPSRFSGS<br>GSGTDFTLTISSLQPEDFATYYCQQAHSSPITFGGGTKVEIKGGGGSGGGGSGGGGSGGGGSEVQ<br>LLESGGGLVQPGGSLRLSCAASGFTFSNYAMSWVRQAPGKGLEWVSAISGSGGSTYYADSVKGRF<br>TISRDNSKNTLYLQMNSLRAEDTAVYYCARPGDGYYEGVYFDYWGQGTLVTVSSLEPKSCDKTHT<br>CPPCPIYIWAPLAGTCGVLLLSLVITLYCRSKRSRLLHSDYMNMTPRRPGPTRKHYQPYAPPRDE<br>AAYRSRVKFSRSADAPAYQQGQNQLYNELNLGRREEYDVLDKRRGRDPEMGGKPRRKNPQEGLYN<br>ELQKDKMAEAYSEIGMKGERRRGKGHDGLYQGLSTATKDTYDALHMQALPPR |
| 497 | DIQMTQSPSSLSASVGDRVTITCRASQSISSYLNWYQQKPGKAPKLLIYAASSLQSGVPSRFSGS<br>GSGTDFTLTISSLQPEDFATYYCQQAHSSPITFGGGTKVEIKGGGGSGGGGSGGGGSGGGGSEVQ<br>LLESGGGLVQPGGSLRLSCAASGFTFSNYAMSWVRQAPGKGLEWVSAISGSGGSTYYADSVKGRF<br>TISRDNSKNTLYLQMNSLRAEDTAVYYCARPGDGYYEGVYFDYWGQGTLVTVSSLEPKSCDKTHT |

-continued

| SEQ ID NO. | AMINO ACID SEQUENCE |
|---|---|
| | CPPCPIYIWAPLAGTCGVLLLSLVITLYCTKKKYSSSVHDPNGEYMEMRAVNTAKKSRLTDVTLR<br>VKFSRSADAPAYQQGQNQLYNELNLGRREEYDVLDKRRGRDPEMGGKPRRKNPQEGLYNELQKDK<br>MAEAYSEIGMKGERRRGKGHDGLYQGLSTATKDTYDALHMQALPPR |
| 498 | DIQMTQSPSSLSASVGDRVTITCRASQSISSYLNWYQQKPGKAPKLLIYAASSLQSGVPSRFSGS<br>GSGTDFTLTISSLQPEDFATYYCQQAHSSPITFGGGTKVEIKGGGGSGGGGSGGGGSGGGGSEVQ<br>LLESGGGLVQPGGSLRLSCAASGFTFSNYAMSWVRQAPGKGLEWVSAISGSGGSTYYADSVKGRF<br>TISRDNSKNTLYLQMNSLRAEDTAVYYCARPGDGYYEGVYFDYWGQGTLVTVSSLEPKSCDKTHT<br>CPPCPFWVLVVVGGVLACYSLLVTVAFIIFWVKRGRKKLLYIFKQPEMRPVQTTQEEDGCSCRFP<br>EEEEGGCELRVKFSRSADAPAYQQGQNQLYNELNLGRREEYDVLDKRRGRDPEMGGKPRRKNPQE<br>GLYNELQKDKMAEAYSEIGMKGERRRGKGHDGLYQGLSTATKDTYDALHMQALPPR |
| 499 | DIQMTQSPSSLSASVGDRVTITCRASQSISSYLNWYQQKPGKAPKLLIYAASSLQSGVPSRESGS<br>GSGTDFTLTISSLQPEDFATYYCQQAHSSPITFGGGTKVEIKGGGGSGGGGSGGGGSGGGGSEVQ<br>LLESGGGLVQPGGSLRLSCAASGFTFSNYAMSWVRQAPGKGLEWVSAISGSGGSTYYADSVKGRF<br>TISRDNSKNTLYLQMNSLRAEDTAVYYCARPGDGYYEGVYFDYWGQGTLVTVSSLEPKSCDKTHT<br>CPPCPFWVLVVVGGVLACYSLLVTVAFIIFWVRSKRSRLLHSDYMNMTPRRPGPTRKHYQPYAPP<br>RDFAAYRSRVKFSRSADAPAYQQGQNQLYNELNLGRREEYDVLDKRRGRDPEMGGKPRRKNPQEG<br>LYNELQKDKMAEAYSEIGMKGERRRGKGHDGLYQGLSTATKDTYDALHMQALPPR |
| 500 | DIQMTQSPSSLSASVGDRVTITCRASQSISSYLNWYQQKPGKAPKLLIYAASSLQSGVPSRFSGS<br>GSGTDFTLTISSLQPEDFATYYCQQAHSSPITFGGGTKVEIKGGGGSGGGGSGGGGSGGGGSEVQ<br>LLESGGGLVQPGGSLRLSCAASGFTFSNYAMSWVRQAPGKGLEWVSAISGSGGSTYYADSVKGRF<br>TISRDNSKNTLYLQMNSLRAEDTAVYYCARPGDGYYEGVYFDYWGQGTLVTVSSLEPKSCDKTHT<br>CPPCPFWVLVVVGGVLACYSLLVTVAFIIFWVTKKKYSSSVHDPNGEYMEMRAVNTAKKSRLTDV<br>TLRVKFSRSADAPAYQQGQNQLYNELNLGRREEYDVLDKRRGRDPEMGGKPRRKNPQEGLYNELQ<br>KDKMAEAYSEIGMKGERRRGKGHDGLYQGLSTATKDTYDALHMQALPPR |

In particular embodiments, a CAR comprises an antibody or antigen binding fragment thereof comprising an amino acid sequence set forth in SEQ ID NO: 89; a spacer domain comprising an amino acid sequence set forth in SEQ ID NO: 145, SEQ ID NO: 146, SEQ ID NO: 148, or SEQ ID NO: 150; a transmembrane domain comprising an amino acid sequence set forth in SEQ ID NO: 151 or SEQ ID NO: 153; a costimulatory domain comprising an amino acid sequence set forth in SEQ ID NO: 159, SEQ ID NO: 160, or SEQ ID NO: 162; and a primary signaling domain comprising an amino acid sequence set forth in SEQ ID NO: 158. In particular embodiments, a CAR comprises an amino acid sequence set forth in any one of SEQ ID NOs: 501, 502, 503, 504, 505, 506, 507, 508, 509, 510, 511, 512, 513, 514, 515, 516, 517, 518, 519, 520, 521, 522, 523, and 524.

| SEQ ID NO. | AMINO ACID SEQUENCE |
|---|---|
| 501 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCAREGSHDYKSSNWEDPWGQGTLVTVSSGGGGSG<br>GGGSGGGGSGGGGSDIQMTQSPSSLSASVGDRVTITCQASQDIANYLNWYQQKPGKAPKLLIYDA<br>SNLETGVPSRFSGSGSGTDFTFTISSLQPEDIATYYCQQHENLPLTFGGGTKVEIKTTTPAPRPP<br>TPAPTIASQPLSLRPEACRPAAGGAVHTRGLDFACDIYIWAPLAGTCGVLLLSLVITLYCKRGRK<br>KLLYIFKQPFMRPVQTTQEEDGCSCRFPEEEEGGCELRVKFSRSADAPAYQQGQNQLYNELNLGR<br>REEYDVLDKRRGRDPEMGGKPRRKNPQEGLYNELQKDKMAEAYSEIGMKGERRRGKGHDGLYQGL<br>STATKDTYDALHMQALPPR |
| 502 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCAREGSHDYKSSNWEDPWGQGTLVTVSSGGGGSG<br>GGGSGGGGSGGGGSDIQMTQSPSSLSASVGDRVTITCQASQDIANYLNWYQQKPGKAPKLLIYDA<br>SNLETGVPSRFSGSGSGTDFTFTISSLQPEDIATYYCQQHFNLPLTFGGGTKVEIKTTTPAPRPP<br>TPAPTIASQPLSLRPEACRPAAGGAVHTRGLDFACDIYIWAPLAGTCGVLLLSLVITLYCRSKRS<br>RLLHSDYMNMTPRRPGPTRKHYQPYAPPRDFAAYRSRVKFSRSADAPAYQQGQNQLYNELNLGRR<br>EEYDVLDKRRGRDPEMGGKPRRKNPQEGLYNELQKDKMAEAYSEIGMKGERRRGKGHDGLYQGLS<br>TATKDTYDALHMQALPPR |
| 503 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCAREGSHDYKSSNWEDPWGQGTLVTVSSGGGGSG<br>GGGSGGGGSGGGGSDIQMTQSPSSLSASVGDRVTITCQASQDIANYLNWYQQKPGKAPKLLIYDA<br>SNLETGVPSRFSGSGSGTDFTFTISSLQPEDIATYYCQQHFNLPLTFGGGTKVEIKTTTPAPRPP<br>TPAPTIASQPLSLRPEACRPAAGGAVHTRGLDFACDIYIWAPLAGTCGVLLLSLVITLYCTKKKY<br>SSSVHDPNGEYMFMRAVNTAKKSRLTDVTLRVKFSRSADAPAYQQGQNQLYNELNLGRREEYDVL<br>DKRRGRDPEMGGKPRRKNPQEGLYNELQKDKMAEAYSEIGMKGERRRGKGHDGLYQGLSTATKDT<br>YDALHMQALPPR |
| 504 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCAREGSHDYKSSNWEDPWGQGTLVTVSSGGGGSG<br>GGGSGGGGSGGGGSDIQMTQSPSSLSASVGDRVTITCQASQDIANYLNWYQQKPGKAPKLLIYDA<br>SNLETGVPSRFSGSGSGTDFTFTISSLQPEDIATYYCQQHFNLPLTFGGGTKVEIKTTTPAPRPP |

-continued

| SEQ ID NO. | AMINO ACID SEQUENCE |
|---|---|
| | TPAPTIASQPLSLRPEACRPAAGGAVHTRGLDFACDEWVLVVVGGVLACYSLLVTVAFIIFWVKR<br>GRKKLLYIFKQPFMRPVQTTQEEDGCSCRFPEEEEGGCELRVKFSRSADAPAYQQGQNQLYNELN<br>LGRREEYDVLDKRRGRDPEMGGKPRRKNPQEGLYNELQKDKMAEAYSEIGMKGERRRGKGHDGLY<br>QGLSTATKDTYDALHMQALPPR |
| 505 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCAREGSHDYKSSNWEDPWGQGTLVTVSSGGGGSG<br>GGGSGGGGSGGGGSDIQMTQSPSSLSASVGDRVTITCQASQDIANYLNWYQQKPGKAPKLLIYDA<br>SNLETGVPSRFSGSGSGTDFTFTISSLQPEDIATYYCQQHENLPLTFGGGTKVEIKTTTPAPRPP<br>TPAPTIASQPLSLRPEACRPAAGGAVHTRGLDFACDFWVLVVVGGVLACYSLLVTVAFIIFWVRS<br>KRSRLLHSDYMNMTPRRPGPTRKHYQPYAPPRDFAAYRSRVKFSRSADAPAYQQGQNQLYNELNL<br>GRREEYDVLDKRRGRDPEMGGKPRRKNPQEGLYNELQKDKMAEAYSEIGMKGERRRGKGHDGLYQ<br>GLSTATKDTYDALHMQALPPR |
| 506 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCAREGSHDYKSSNWEDPWGQGTLVTVSSGGGGSG<br>GGGSGGGGSGGGGSDIQMTQSPSSLSASVGDRVTITCQASQDIANYLNWYQQKPGKAPKLLIYDA<br>SNLETGVPSRFSGSGSGTDFTFTISSLQPEDIATYYCQQHFNLPLTFGGGTKVEIKTTTPAPRPP<br>TPAPTIASQPLSLRPEACRPAAGGAVHTRGLDFACDFWVLVVVGGVLACYSLLVTVAFIIFWVTK<br>KKYSSSVHDPNGEYMEMRAVNTAKKSRLTDVTLRVKFSRSADAPAYQQGQNQLYNELNLGRREEY<br>DVLDKRRGRDPEMGGKPRRKNPQEGLYNELQKDKMAEAYSEIGMKGERRRGKGHDGLYQGLSTAT<br>KDTYDALHMQALPPR |
| 507 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCAREGSHDYKSSNWFDPWGQGTLVTVSSGGGGSG<br>GGGSGGGGSGGGGSDIQMTQSPSSLSASVGDRVTITCQASQDIANYLNWYQQKPGKAPKLLIYDA<br>SNLETGVPSRFSGSGSGTDFTFTISSLQPEDIATYYCQQHFNLPLTFGGGTKVEIKIEVMYPPPY<br>LDNEKSNGTIIHVKGKHLCPSPLFPGPSKPIYIWAPLAGTCGVLLLSLVITLYCKRGRKKLLYIF<br>KQPFMRPVQTTQEEDGCSCRFPEEEEGGCELRVKFSRSADAPAYQQGQNQLYNELNLGRREEYDV<br>LDKRRGRDPEMGGKPRRKNPQEGLYNELQKDKMAEAYSEIGMKGERRRGKGHDGLYQGLSTATKD<br>TYDALHMQALPPR |
| 508 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCAREGSHDYKSSNWEDPWGQGTLVTVSSGGGGSG<br>GGGSGGGGSGGGGSDIQMTQSPSSLSASVGDRVTITCQASQDIANYLNWYQQKPGKAPKLLIYDA<br>SNLETGVPSRFSGSGSGTDFTFTISSLQPEDIATYYCQQHFNLPLTFGGGTKVEIKIEVMYPPPY<br>LDNEKSNGTIIHVKGKHLCPSPLFPGPSKPIYIWAPLAGTCGVLLLSLVITLYCRSKRSRLLHSD<br>YMNMTPRRPGPTRKHYQPYAPPRDFAAYRSRVKFSRSADAPAYQQGQNQLYNELNLGRREEYDVL<br>DKRRGRDPEMGGKPRRKNPQEGLYNELQKDKMAEAYSEIGMKGERRRGKGHDGLYQGLSTATKDT<br>YDALHMQALPPR |
| 509 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCAREGSHDYKSSNWFDPWGQGTLVTVSSGGGGSG<br>GGGSGGGGSGGGGSDIQMTQSPSSLSASVGDRVTITCQASQDIANYLNWYQQKPGKAPKLLIYDA<br>SNLETGVPSRFSGSGSGTDFTFTISSLQPEDIATYYCQQHFNLPLTFGGGTKVEIKIEVMYPPPY<br>LDNEKSNGTIIHVKGKHLCPSPLFPGPSKPIYIWAPLAGTCGVLLLSLVITLYCTKKKYSSSVHD<br>PNGEYMFMRAVNTAKKSRLTDVTLRVKFSRSADAPAYQQGQNQLYNELNLGRREEYDVLDKRRGR<br>DPEMGGKPRRKNPQEGLYNELQKDKMAEAYSEIGMKGERRRGKGHDGLYQGLSTATKDTYDALHM<br>QALPPR |
| 510 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCAREGSHDYKSSNWEDPWGQGTLVTVSSGGGGSG<br>GGGSGGGGSGGGGSDIQMTQSPSSLSASVGDRVTITCQASQDIANYLNWYQQKPGKAPKLLIYDA<br>SNLETGVPSRFSGSGSGTDFTFTISSLQPEDIATYYCQQHFNLPLTFGGGTKVEIKIEVMYPPPY<br>LDNEKSNGTIIHVKGKHLCPSPLFPGPSKPFWVLVVVGGVLACYSLLVTVAFIIFWVKRGRKKLL<br>YIFKQPFMRPVQTTQEEDGCSCRFPEEEEGGCELRVKFSRSADAPAYQQGQNQLYNELNLGRREE<br>YDVLDKRRGRDPEMGGKPRRKNPQEGLYNELQKDKMAEAYSEIGMKGERRRGKGHDGLYQGLSTA<br>TKDTYDALHMQALPPR |
| 511 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCAREGSHDYKSSNWEDPWGQGTLVTVSSGGGGSG<br>GGGSGGGGSGGGGSDIQMTQSPSSLSASVGDRVTITCQASQDIANYLNWYQQKPGKAPKLLIYDA<br>SNLETGVPSRFSGSGSGTDFTFTISSLQPEDIATYYCQQHFNLPLTFGGGTKVEIKIEVMYPPPY<br>LDNEKSNGTIIHVKGKHLCPSPLFPGPSKPFWVLVVVGGVLACYSLLVTVAFIIFWVRSKRSRLL<br>HSDYMNMTPRRPGPTRKHYQPYAPPRDFAAYRSRVKFSRSADAPAYQQGQNQLYNELNLGRREEY<br>DVLDKRRGRDPEMGGKPRRKNPQEGLYNELQKDKMAEAYSEIGMKGERRRGKGHDGLYQGLSTAT<br>KDTYDALHMQALPPR |
| 512 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCAREGSHDYKSSNWFDPWGQGTLVTVSSGGGGSG<br>GGGSGGGGSGGGGSDIQMTQSPSSLSASVGDRVTITCQASQDIANYLNWYQQKPGKAPKLLIYDA<br>SNLETGVPSRFSGSGSGTDFTFTISSLQPEDIATYYCQQHENLPLTFGGGTKVEIKIEVMYPPPY |

-continued

| SEQ ID NO. | AMINO ACID SEQUENCE |
|---|---|
| | LDNEKSNGTIIHVKGKHLCPSPLFPGPSKPFWVLVVVGGVLACYSLLVTVAFIIFWVTKKKYSSS<br>VHDPNGEYMEMRAVNTAKKSRLTDVTLRVKFSRSADAPAYQQGQNQLYNELNLGRREEYDVLDKR<br>RGRDPEMGGKPRRKNPQEGLYNELQKDKMAEAYSEIGMKGERRRGKGHDGLYQGLSTATKDTYDA<br>LHMQALPPR |
| 513 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCAREGSHDYKSSNWEDPWGQGTLVTVSSGGGGSG<br>GGGSGGGGSGGGGSDIQMTQSPSSLSASVGDRVTITCQASQDIANYLNWYQQKPGKAPKLLIYDA<br>SNLETGVPSRFSGSGSGTDFTFTISSLQPEDIATYYCQQHFNLPLTFGGGTKVEIKESKYGPPCP<br>PCPIYIWAPLAGTCGVLLLSLVITLYCKRGRKKLLYIFKQPFMRPVQTTQEEDGCSCRFPEEEEG<br>GCELRVKFSRSADAPAYQQGQNQLYNELNLGRREEYDVLDKRRGRDPEMGGKPRRKNPQEGLYNE<br>LQKDKMAEAYSEIGMKGERRRGKGHDGLYQGLSTATKDTYDALHMQALPPR |
| 514 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCAREGSHDYKSSNWFDPWGQGTLVTVSSGGGGSG<br>GGGSGGGGSGGGGSDIQMTQSPSSLSASVGDRVTITCQASQDIANYLNWYQQKPGKAPKLLIYDA<br>SNLETGVPSRFSGSGSGTDFTFTISSLQPEDIATYYCQQHFNLPLTFGGGTKVEIKESKYGPPCP<br>PCPIYIWAPLAGTCGVLLLSLVITLYCRSKRSRLLHSDYMNMTPRRPGPTRKHYQPYAPPRDFAA<br>YRSRVKFSRSADAPAYQQGQNQLYNELNLGRREEYDVLDKRRGRDPEMGGKPRRKNPQEGLYNEL<br>QKDKMAEAYSEIGMKGERRRGKGHDGLYQGLSTATKDTYDALHMQALPPR |
| 515 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCAREGSHDYKSSNWEDPWGQGTLVTVSSGGGGSG<br>GGGSGGGGSGGGGSDIQMTQSPSSLSASVGDRVTITCQASQDIANYLNWYQQKPGKAPKLLIYDA<br>SNLETGVPSRFSGSGSGTDFTFTISSLQPEDIATYYCQQHFNLPLTFGGGTKVEIKESKYGPPCP<br>PCPIYIWAPLAGTCGVLLLSLVITLYCTKKKYSSSVHDPNGEYMEMRAVNTAKKSRLTDVTLRVK<br>FSRSADAPAYQQGQNQLYNELNLGRREEYDVLDKRRGRDPEMGGKPRRKNPQEGLYNELQKDKMA<br>EAYSEIGMKGERRRGKGHDGLYQGLSTATKDTYDALHMQALPPR |
| 516 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCAREGSHDYKSSNWFDPWGQGTLVTVSSGGGGSG<br>GGGSGGGGSGGGGSDIQMTQSPSSLSASVGDRVTITCQASQDIANYLNWYQQKPGKAPKLLIYDA<br>SNLETGVPSRFSGSGSGTDFTFTISSLQPEDIATYYCQQHFNLPLTFGGGTKVEIKESKYGPPCP<br>PCPFWVLVVVGGVLACYSLLVTVAFIIFWVKRGRKKLLYIFKQPFMRPVQTTQEEDGCSCRFPEE<br>EEGGCELRVKFSRSADAPAYQQGQNQLYNELNLGRREEYDVLDKRRGRDPEMGGKPRRKNPQEGL<br>YNELQKDKMAEAYSEIGMKGERRRGKGHDGLYQGLSTATKDTYDALHMQALPPR |
| 517 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCAREGSHDYKSSNWEDPWGQGTLVTVSSGGGGSG<br>GGGSGGGGSGGGGSDIQMTQSPSSLSASVGDRVTITCQASQDIANYLNWYQQKPGKAPKLLIYDA<br>SNLETGVPSRFSGSGSGTDFTFTISSLQPEDIATYYCQQHFNLPLTFGGGTKVEIKESKYGPPCP<br>PCPFWVLVVVGGVLACYSLLVTVAFIIFWVRSKRSRLLHSDYMNMTPRRPGPTRKHYQPYAPPRD<br>FAAYRSRVKFSRSADAPAYQQGQNQLYNELNLGRREEYDVLDKRRGRDPEMGGKPRRKNPQEGLY<br>NELQKDKMAEAYSEIGMKGERRRGKGHDGLYQGLSTATKDTYDALHMQALPPR |
| 518 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCAREGSHDYKSSNWEDPWGQGTLVTVSSGGGGSG<br>GGGSGGGGSGGGGSDIQMTQSPSSLSASVGDRVTITCQASQDIANYLNWYQQKPGKAPKLLIYDA<br>SNLETGVPSRFSGSGSGTDFTFTISSLQPEDIATYYCQQHENLPLTFGGGTKVEIKESKYGPPCP<br>PCPFWVLVVVGGVLACYSLLVTVAFIIFWVTKKKYSSSVHDPNGEYMEMRAVNTAKKSRLTDVTL<br>RVKFSRSADAPAYQQGQNQLYNELNLGRREEYDVLDKRRGRDPEMGGKPRRKNPQEGLYNELQKD<br>KMAEAYSEIGMKGERRRGKGHDGLYQGLSTATKDTYDALHMQALPPR |
| 519 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCAREGSHDYKSSNWEDPWGQGTLVTVSSGGGGSG<br>GGGSGGGGSGGGGSDIQMTQSPSSLSASVGDRVTITCQASQDIANYLNWYQQKPGKAPKLLIYDA<br>SNLETGVPSRFSGSGSGTDFTFTISSLQPEDIATYYCQQHFNLPLTFGGGTKVEIKLEPKSCDKT<br>HTCPPCPIYIWAPLAGTCGVLLLSLVITLYCKRGRKKLLYIFKQPFMRPVQTTQEEDGCSCRFPE<br>EEEGGCELRVKFSRSADAPAYQQGQNQLYNELNLGRREEYDVLDKRRGRDPEMGGKPRRKNPQEG<br>LYNELQKDKMAEAYSEIGMKGERRRGKGHDGLYQGLSTATKDTYDALHMQALPPR |
| 520 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCAREGSHDYKSSNWEDPWGQGTLVTVSSGGGGSG<br>GGGSGGGGSGGGGSDIQMTQSPSSLSASVGDRVTITCQASQDIANYLNWYQQKPGKAPKLLIYDA<br>SNLETGVPSRFSGSGSGTDFTFTISSLQPEDIATYYCQQHFNLPLTFGGGTKVEIKLEPKSCDKT<br>HTCPPCPIYIWAPLAGTCGVLLLSLVITLYCRSKRSRLLHSDYMNMTPRRPGPTRKHYQPYAPPR<br>DFAAYRSRVKFSRSADAPAYQQGQNQLYNELNLGRREEYDVLDKRRGRDPEMGGKPRRKNPQEGL<br>YNELQKDKMAEAYSEIGMKGERRRGKGHDGLYQGLSTATKDTYDALHMQALPPR |
| 521 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCAREGSHDYKSSNWEDPWGQGTLVTVSSGGGGSG<br>GGGSGGGGSGGGGSDIQMTQSPSSLSASVGDRVTITCQASQDIANYLNWYQQKPGKAPKLLIYDA<br>SNLETGVPSRFSGSGSGTDFTFTISSLQPEDIATYYCQQHFNLPLTFGGGTKVEIKLEPKSCDKT |

-continued

| SEQ ID NO. | AMINO ACID SEQUENCE |
|---|---|
| | HTCPPCPIYIWAPLAGTCGVLLLSLVITLYCTKKKYSSSVHDPNGEYMEMRAVNTAKKSRLTDVT<br>LRVKFSRSADAPAYQQGQNQLYNELNLGRREEYDVLDKRRGRDPEMGGKPRRKNPQEGLYNELQK<br>DKMAEAYSEIGMKGERRRGKGHDGLYQGLSTATKDTYDALHMQALPPR |
| 522 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCAREGSHDYKSSNWEDPWGQGTLVTVSSGGGGSG<br>GGGSGGGGSGGGGSDIQMTQSPSSLSASVGDRVTITCQASQDIANYLNWYQQKPGKAPKLLIYDA<br>SNLETGVPSRFSGSGSGTDFTFTISSLQPEDIATYYCQQHENLPLTFGGGTKVEIKLEPKSCDKT<br>HTCPPCPFWVLVVVGGVLACYSLLVTVAFIIFWVKRGRKKLLYIFKQPEMRPVQTTQEEDGCSCR<br>FPEEEEGGCELRVKFSRSADAPAYQQGQNQLYNELNLGRREEYDVLDKRRGRDPEMGGKPRRKNP<br>QEGLYNELQKDKMAEAYSEIGMKGERRRGKGHDGLYQGLSTATKDTYDALHMQALPPR |
| 523 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCAREGSHDYKSSNWEDPWGQGTLVTVSSGGGGSG<br>GGGSGGGGSGGGGSDIQMTQSPSSLSASVGDRVTITCQASQDIANYLNWYQQKPGKAPKLLIYDA<br>SNLETGVPSRFSGSGSGTDFTFTISSLQPEDIATYYCQQHFNLPLTFGGGTKVEIKLEPKSCDKT<br>HTCPPCPFWVLVVVGGVLACYSLLVTVAFIIFWVRSKRSRLLHSDYMNMTPRRPGPTRKHYQPYA<br>PPRDFAAYRSRVKFSRSADAPAYQQGQNQLYNELNLGRREEYDVLDKRRGRDPEMGGKPRRKNPQ<br>EGLYNELQKDKMAEAYSEIGMKGERRRGKGHDGLYQGLSTATKDTYDALHMQALPPR |
| 524 | QITLKESGPTLVKPTQTLTLTCTFSGFSLSTSGVGVGWIRQPPGKALEWLALIYWNDEKRYSPSL<br>KSRLTITKDTSKNQVVLTMTNMDPVDTAVYYCAREGSHDYKSSNWEDPWGQGTLVTVSSGGGGSG<br>GGGSGGGGSGGGGSDIQMTQSPSSLSASVGDRVTITCQASQDIANYLNWYQQKPGKAPKLLIYDA<br>SNLETGVPSRFSGSGSGTDFTFTISSLQPEDIATYYCQQHFNLPLTFGGGTKVEIKLEPKSCDKT<br>HTCPPCPFWVLVVVGGVLACYSLLVTVAFIIFWVTKKKYSSSVHDPNGEYMEMRAVNTAKKSRLT<br>DVTLRVKFSRSADAPAYQQGQNQLYNELNLGRREEYDVLDKRRGRDPEMGGKPRRKNPQEGLYNE<br>LQKDKMAEAYSEIGMKGERRRGKGHDGLYQGLSTATKDTYDALHMQALPPR |

In preferred embodiments, a CAR comprises an antibody or antigen binding fragment thereof comprising an amino acid sequence set forth in SEQ ID NO: 90; a spacer domain comprising an amino acid sequence set forth in SEQ ID NO: 145, SEQ ID NO: 146, SEQ ID NO: 148, or SEQ ID NO: 150; a transmembrane domain comprising an amino acid sequence set forth in SEQ ID NO: 151 or SEQ ID NO: 153; a costimulatory domain comprising an amino acid sequence set forth in SEQ ID NO: 159, SEQ ID NO: 160, or SEQ ID NO: 162; and a primary signaling domain comprising an amino acid sequence set forth in SEQ ID NO: 158. In preferred embodiments, a CAR comprises an amino acid sequence set forth in any one of SEQ ID NOs: 525, 526, 527, 528, 529, 530, 531, 532, 533, 534, 535, 536, 537, 538, 539, 540, 541, 542, 543, 544, 545, 546, 547, and 548.

| SEQ ID NO. | AMINO ACID SEQUENCE |
|---|---|
| 525 | DIQMTQSPSSLSASVGDRVTITCQASQDIANYLNWYQQKPGKAPKLLIYDASNLETGVPSRFSGS<br>GSGTDFTFTISSLQPEDIATYYCQQHFNLPLTFGGGTKVEIKGGGGSGGGGSGGGGSGGGGSQIT<br>LKESGPTLVKPTQTLTLTCTFSGFSLSTSGVGVGWIRQPPGKALEWLALIYWNDEKRYSPSLKSR<br>LTITKDTSKNQVVLTMTNMDPVDTAVYYCAREGSHDYKSSNWEDPWGQGTLVTVSSTTTPAPRPP<br>TPAPTIASQPLSLRPEACRPAAGGAVHTRGLDFACDIYIWAPLAGTCGVLLLSLVITLYCKRGRK<br>KLLYIFKQPFMRPVQTTQEEDGCSCRFPEEEEGGCELRVKFSRSADAPAYQQGQNQLYNELNLGR<br>REEYDVLDKRRGRDPEMGGKPRRKNPQEGLYNELQKDKMAEAYSEIGMKGERRRGKGHDGLYQGL<br>STATKDTYDALHMQALPPR |
| 526 | DIQMTQSPSSLSASVGDRVTITCQASQDIANYLNWYQQKPGKAPKLLIYDASNLETGVPSRFSGS<br>GSGTDFTFTISSLQPEDIATYYCQQHFNLPLTFGGGTKVEIKGGGGSGGGGSGGGGSGGGGSQIT<br>LKESGPTLVKPTQTLTLTCTFSGFSLSTSGVGVGWIRQPPGKALEWLALIYWNDEKRYSPSLKSR<br>LTITKDTSKNQVVLTMTNMDPVDTAVYYCAREGSHDYKSSNWEDPWGQGTLVTVSSTTTPAPRPP<br>TPAPTIASQPLSLRPEACRPAAGGAVHTRGLDFACDIYIWAPLAGTCGVLLLSLVITLYCRSKRS<br>RLLHSDYMNMTPRRPGPTRKHYQPYAPPRDFAAYRSRVKFSRSADAPAYQQGQNQLYNELNLGRR<br>EEYDVLDKRRGRDPEMGGKPRRKNPQEGLYNELQKDKMAEAYSEIGMKGERRRGKGHDGLYQGLS<br>TATKDTYDALHMQALPPR |
| 527 | DIQMTQSPSSLSASVGDRVTITCQASQDIANYLNWYQQKPGKAPKLLIYDASNLETGVPSRFSGS<br>GSGTDFTFTISSLQPEDIATYYCQQHFNLPLTFGGGTKVEIKGGGGSGGGGSGGGGSGGGGSQIT<br>LKESGPTLVKPTQTLTLTCTFSGFSLSTSGVGVGWIRQPPGKALEWLALIYWNDEKRYSPSLKSR<br>LTITKDTSKNQVVLTMTNMDPVDTAVYYCAREGSHDYKSSNWEDPWGQGTLVTVSSTTTPAPRPP<br>TPAPTIASQPLSLRPEACRPAAGGAVHTRGLDFACDIYIWAPLAGTCGVLLLSLVITLYCTKKKY<br>SSSVHDPNGEYMFMRAVNTAKKSRLTDVTLRVKFSRSADAPAYQQGQNQLYNELNLGRREEYDVL<br>DKRRGRDPEMGGKPRRKNPQEGLYNELQKDKMAEAYSEIGMKGERRRGKGHDGLYQGLSTATKDT<br>YDALHMQALPPR |
| 528 | DIQMTQSPSSLSASVGDRVTITCQASQDIANYLNWYQQKPGKAPKLLIYDASNLETGVPSRFSGS<br>GSGTDFTFTISSLQPEDIATYYCQQHFNLPLTFGGGTKVEIKGGGGSGGGGSGGGGSGGGGSQIT<br>LKESGPTLVKPTQTLTLTCTFSGFSLSTSGVGVGWIRQPPGKALEWLALIYWNDEKRYSPSLKSR<br>LTITKDTSKNQVVLTMTNMDPVDTAVYYCAREGSHDYKSSNWEDPWGQGTLVTVSSTTTPAPRPP |

-continued

| SEQ ID NO. | AMINO ACID SEQUENCE |
|---|---|
| | TPAPTIASQPLSLRPEACRPAAGGAVHTRGLDFACDFWVLVVVGGVLACYSLLVTVAFIIFWVKR GRKKLLYIFKQPFMRPVQTTQEEDGCSCRFPEEEEGGCELRVKFSRSADAPAYQQGQNQLYNELN LGRREEYDVLDKRRGRDPEMGGKPRRKNPQEGLYNELQKDKMAEAYSEIGMKGERRRGKGHDGLY QGLSTATKDTYDALHMQALPPR |
| 529 | DIQMTQSPSSLSASVGDRVTITCQASQDIANYLNWYQQKPGKAPKLLIYDASNLETGVPSRFSGS GSGTDFTFTISSLQPEDIATYYCQQHFNLPLTFGGGTKVEIKGGGGSGGGGSGGGGSGGGGSQIT LKESGPTLVKPTQTLTLTCTFSGFSLSTSGVGVGWIRQPPGKALEWLALIYWNDEKRYSPSLKSR LTITKDTSKNQVVLTMTNMDPVDTAVYYCAREGSHDYKSSNWEDPWGQGTLVTVSSTTTPAPRPP TPAPTIASQPLSLRPEACRPAAGGAVHTRGLDFACDFWVLVVVGGVLACYSLLVTVAFIIFWVRS KRSRLLHSDYMNMTPRRPGPTRKHYQPYAPPRDFAAYRSRVKFSRSADAPAYQQGQNQLYNELNL GRREEYDVLDKRRGRDPEMGGKPRRKNPQEGLYNELQKDKMAEAYSEIGMKGERRRGKGHDGLYQ GLSTATKDTYDALHMQALPPR |
| 530 | DIQMTQSPSSLSASVGDRVTITCQASQDIANYLNWYQQKPGKAPKLLIYDASNLETGVPSRFSGS GSGTDFTFTISSLQPEDIATYYCQQHFNLPLTFGGGTKVEIKGGGGSGGGGSGGGGSGGGGSQIT LKESGPTLVKPTQTLTLTCTFSGFSLSTSGVGVGWIRQPPGKALEWLALIYWNDEKRYSPSLKSR LTITKDTSKNQVVLTMTNMDPVDTAVYYCAREGSHDYKSSNWEDPWGQGTLVTVSSTTTPAPRPP TPAPTIASQPLSLRPEACRPAAGGAVHTRGLDFACDFWVLVVVGGVLACYSLLVTVAFIIFWVTK KKYSSSVHDPNGEYMEMRAVNTAKKSRLTDVTLRVKFSRSADAPAYQQGQNQLYNELNLGRREEY DVLDKRRGRDPEMGGKPRRKNPQEGLYNELQKDKMAEAYSEIGMKGERRRGKGHDGLYQGLSTAT KDTYDALHMQALPPR |
| 531 | DIQMTQSPSSLSASVGDRVTITCQASQDIANYLNWYQQKPGKAPKLLIYDASNLETGVPSRFSGS GSGTDFTFTISSLQPEDIATYYCQQHFNLPLTFGGGTKVEIKGGGGSGGGGSGGGGSGGGGSQIT LKESGPTLVKPTQTLTLTCTFSGFSLSTSGVGVGWIRQPPGKALEWLALIYWNDEKRYSPSLKSR LTITKDTSKNQVVLTMTNMDPVDTAVYYCAREGSHDYKSSNWEDPWGQGTLVTVSSIEVMYPPPY LDNEKSNGTIIHVKGKHLCPSPLFPGPSKPIYIWAPLAGTCGVLLLSLVITLYCKRGRKKLLYIF KQPFMRPVQTTQEEDGCSCRFPEEEEGGCELRVKFSRSADAPAYQQGQNQLYNELNLGRREEYDV LDKRRGRDPEMGGKPRRKNPQEGLYNELQKDKMAEAYSEIGMKGERRRGKGHDGLYQGLSTATKD TYDALHMQALPPR |
| 532 | DIQMTQSPSSLSASVGDRVTITCQASQDIANYLNWYQQKPGKAPKLLIYDASNLETGVPSRFSGS GSGTDFTFTISSLQPEDIATYYCQQHFNLPLTFGGGTKVEIKGGGGSGGGGSGGGGSGGGGSQIT LKESGPTLVKPTQTLTLTCTFSGFSLSTSGVGVGWIRQPPGKALEWLALIYWNDEKRYSPSLKSR LTITKDTSKNQVVLTMTNMDPVDTAVYYCAREGSHDYKSSNWEDPWGQGTLVTVSSIEVMYPPPY LDNEKSNGTIIHVKGKHLCPSPLFPGPSKPIYIWAPLAGTCGVLLLSLVITLYCRSKRSRLLHSD YMNMTPRRPGPTRKHYQPYAPPRDFAAYRSRVKFSRSADAPAYQQGQNQLYNELNLGRREEYDVL DKRRGRDPEMGGKPRRKNPQEGLYNELQKDKMAEAYSEIGMKGERRRGKGHDGLYQGLSTATKDT YDALHMQALPPR |
| 533 | DIQMTQSPSSLSASVGDRVTITCQASQDIANYLNWYQQKPGKAPKLLIYDASNLETGVPSRFSGS GSGTDFTFTISSLQPEDIATYYCQQHFNLPLTFGGGTKVEIKGGGGSGGGGSGGGGSGGGGSQIT LKESGPTLVKPTQTLTLTCTFSGFSLSTSGVGVGWIRQPPGKALEWLALIYWNDEKRYSPSLKSR LTITKDTSKNQVVLTMTNMDPVDTAVYYCAREGSHDYKSSNWEDPWGQGTLVTVSSIEVMYPPPY LDNEKSNGTIIHVKGKHLCPSPLFPGPSKPIYIWAPLAGTCGVLLLSLVITLYCTKKKYSSSVHD PNGEYMFMRAVNTAKKSRLTDVTLRVKFSRSADAPAYQQGQNQLYNELNLGRREEYDVLDKRRGR DPEMGGKPRRKNPQEGLYNELQKDKMAEAYSEIGMKGERRRGKGHDGLYQGLSTATKDTYDALHM QALPPR |
| 534 | DIQMTQSPSSLSASVGDRVTITCQASQDIANYLNWYQQKPGKAPKLLIYDASNLETGVPSRFSGS GSGTDFTFTISSLQPEDIATYYCQQHFNLPLTFGGGTKVEIKGGGGSGGGGSGGGGSGGGGSQIT LKESGPTLVKPTQTLTLTCTFSGFSLSTSGVGVGWIRQPPGKALEWLALIYWNDEKRYSPSLKSR LTITKDTSKNQVVLTMTNMDPVDTAVYYCAREGSHDYKSSNWEDPWGQGTLVTVSSIEVMYPPPY LDNEKSNGTIIHVKGKHLCPSPLFPGPSKPFWVLVVVGGVLACYSLLVTVAFIIFWVKRGRKKLL YIFKQPFMRPVQTTQEEDGCSCRFPEEEEGGCELRVKFSRSADAPAYQQGQNQLYNELNLGRREE YDVLDKRRGRDPEMGGKPRRKNPQEGLYNELQKDKMAEAYSEIGMKGERRRGKGHDGLYQGLSTA TKDTYDALHMQALPPR |
| 535 | DIQMTQSPSSLSASVGDRVTITCQASQDIANYLNWYQQKPGKAPKLLIYDASNLETGVPSRFSGS GSGTDFTFTISSLQPEDIATYYCQQHFNLPLTFGGGTKVEIKGGGGSGGGGSGGGGSGGGGSQIT LKESGPTLVKPTQTLTLTCTFSGFSLSTSGVGVGWIRQPPGKALEWLALIYWNDEKRYSPSLKSR LTITKDTSKNQVVLTMTNMDPVDTAVYYCAREGSHDYKSSNWEDPWGQGTLVTVSSIEVMYPPPY LDNEKSNGTIIHVKGKHLCPSPLFPGPSKPFWVLVVVGGVLACYSLLVTVAFIIFWVRSKRSRLL HSDYMNMTPRRPGPTRKHYQPYAPPRDFAAYRSRVKFSRSADAPAYQQGQNQLYNELNLGRREEY DVLDKRRGRDPEMGGKPRRKNPQEGLYNELQKDKMAEAYSEIGMKGERRRGKGHDGLYQGLSTAT KDTYDALHMQALPPR |
| 536 | DIQMTQSPSSLSASVGDRVTITCQASQDIANYLNWYQQKPGKAPKLLIYDASNLETGVPSRFSGS GSGTDFTFTISSLQPEDIATYYCQQHFNLPLTFGGGTKVEIKGGGGSGGGGSGGGGSGGGGSQIT LKESGPTLVKPTQTLTLTCTFSGFSLSTSGVGVGWIRQPPGKALEWLALIYWNDEKRYSPSLKSR LTITKDTSKNQVVLTMTNMDPVDTAVYYCAREGSHDYKSSNWEDPWGQGTLVTVSSIEVMYPPPY LDNEKSNGTIIHVKGKHLCPSPLFPGPSKPFWVLVVVGGVLACYSLLVTVAFIIFWVTKKKYSSS VHDPNGEYMEMRAVNTAKKSRLTDVTLRVKFSRSADAPAYQQGQNQLYNELNLGRREEYDVLDKR RGRDPEMGGKPRRKNPQEGLYNELQKDKMAEAYSEIGMKGERRRGKGHDGLYQGLSTATKDTYDA LHMQALPPR |

-continued

| SEQ ID NO. | AMINO ACID SEQUENCE |
|---|---|
| 537 | DIQMTQSPSSLSASVGDRVTITCQASQDIANYLNWYQQKPGKAPKLLIYDASNLETGVPSRFSGS<br>GSGTDFTFTISSLQPEDIATYYCQQHFNLPLTFGGGTKVEIKGGGGSGGGGSGGGGSGGGGSQIT<br>LKESGPTLVKPTQTLTLTCTFSGFSLSTSGVGVGWIRQPPGKALEWLALIYWNDEKRYSPSLKSR<br>LTITKDTSKNQVVLTMTNMDPVDTAVYYCAREGSHDYKSSNWEDPWGQGTLVTVSSESKYGPPCP<br>PCPIYIWAPLAGTCGVLLLSLVITLYCKRGRKKLLYIFKQPFMRPVQTTQEEDGCSCRFPEEEEG<br>GCELRVKFSRSADAPAYQQGQNQLYNELNLGRREEYDVLDKRRGRDPEMGGKPRRKNPQEGLYNE<br>LQKDKMAEAYSEIGMKGERRRGKGHDGLYQGLSTATKDTYDALHMQALPPR |
| 538 | DIQMTQSPSSLSASVGDRVTITCQASQDIANYLNWYQQKPGKAPKLLIYDASNLETGVPSRFSGS<br>GSGTDFTFTISSLQPEDIATYYCQQHFNLPLTFGGGTKVEIKGGGGSGGGGSGGGGSGGGGSQIT<br>LKESGPTLVKPTQTLTLTCTFSGFSLSTSGVGVGWIRQPPGKALEWLALIYWNDEKRYSPSLKSR<br>LTITKDTSKNQVVLTMTNMDPVDTAVYYCAREGSHDYKSSNWEDPWGQGTLVTVSSESKYGPPCP<br>PCPIYIWAPLAGTCGVLLLSLVITLYCRSKRSRLLHSDYMNMTPRRPGPTRKHYQPYAPPRDFAA<br>YRSRVKFSRSADAPAYQQGQNQLYNELNLGRREEYDVLDKRRGRDPEMGGKPRRKNPQEGLYNEL<br>QKDKMAEAYSEIGMKGERRRGKGHDGLYQGLSTATKDTYDALHMQALPPR |
| 539 | DIQMTQSPSSLSASVGDRVTITCQASQDIANYLNWYQQKPGKAPKLLIYDASNLETGVPSRFSGS<br>GSGTDFTFTISSLQPEDIATYYCQQHFNLPLTFGGGTKVEIKGGGGSGGGGSGGGGSGGGGSQIT<br>LKESGPTLVKPTQTLTLTCTFSGFSLSTSGVGVGWIRQPPGKALEWLALIYWNDEKRYSPSLKSR<br>LTITKDTSKNQVVLTMTNMDPVDTAVYYCAREGSHDYKSSNWEDPWGQGTLVTVSSESKYGPPCP<br>PCPIYIWAPLAGTCGVLLLSLVITLYCTKKKYSSSVHDPNGEYMEMRAVNTAKKSRLTDVTLRVK<br>FSRSADAPAYQQGQNQLYNELNLGRREEYDVLDKRRGRDPEMGGKPRRKNPQEGLYNELQKDKMA<br>EAYSEIGMKGERRRGKGHDGLYQGLSTATKDTYDALHMQALPPR |
| 540 | DIQMTQSPSSLSASVGDRVTITCQASQDIANYLNWYQQKPGKAPKLLIYDASNLETGVPSRFSGS<br>GSGTDFTFTISSLQPEDIATYYCQQHFNLPLTFGGGTKVEIKGGGGSGGGGSGGGGSGGGGSQIT<br>LKESGPTLVKPTQTLTLTCTFSGFSLSTSGVGVGWIRQPPGKALEWLALIYWNDEKRYSPSLKSR<br>LTITKDTSKNQVVLTMTNMDPVDTAVYYCAREGSHDYKSSNWEDPWGQGTLVTVSSESKYGPPCP<br>PCPFWVLVVVGGVLACYSLLVTVAFIIFWVKRGRKKLLYIFKQPFMRPVQTTQEEDGCSCRFPEE<br>EEGGCELRVKFSRSADAPAYQQGQNQLYNELNLGRREEYDVLDKRRGRDPEMGGKPRRKNPQEGL<br>YNELQKDKMAEAYSEIGMKGERRRGKGHDGLYQGLSTATKDTYDALHMQALPPR |
| 541 | DIQMTQSPSSLSASVGDRVTITCQASQDIANYLNWYQQKPGKAPKLLIYDASNLETGVPSRFSGS<br>GSGTDFTFTISSLQPEDIATYYCQQHFNLPLTFGGGTKVEIKGGGGSGGGGSGGGGSGGGGSQIT<br>LKESGPTLVKPTQTLTLTCTFSGFSLSTSGVGVGWIRQPPGKALEWLALIYWNDEKRYSPSLKSR<br>LTITKDTSKNQVVLTMTNMDPVDTAVYYCAREGSHDYKSSNWEDPWGQGTLVTVSSESKYGPPCP<br>PCPFWVLVVVGGVLACYSLLVTVAFIIFWVRSKRSRLLHSDYMNMTPRRPGPTRKHYQPYAPPRD<br>FAAYRSRVKFSRSADAPAYQQGQNQLYNELNLGRREEYDVLDKRRGRDPEMGGKPRRKNPQEGLY<br>NELQKDKMAEAYSEIGMKGERRRGKGHDGLYQGLSTATKDTYDALHMQALPPR |
| 542 | DIQMTQSPSSLSASVGDRVTITCQASQDIANYLNWYQQKPGKAPKLLIYDASNLETGVPSRFSGS<br>GSGTDFTFTISSLQPEDIATYYCQQHFNLPLTFGGGTKVEIKGGGGSGGGGSGGGGSGGGGSQIT<br>LKESGPTLVKPTQTLTLTCTFSGFSLSTSGVGVGWIRQPPGKALEWLALIYWNDEKRYSPSLKSR<br>LTITKDTSKNQVVLTMTNMDPVDTAVYYCAREGSHDYKSSNWEDPWGQGTLVTVSSESKYGPPCP<br>PCPFWVLVVVGGVLACYSLLVTVAFIIFWVTKKKYSSSVHDPNGEYMEMRAVNTAKKSRLTDVTL<br>RVKFSRSADAPAYQQGQNQLYNELNLGRREEYDVLDKRRGRDPEMGGKPRRKNPQEGLYNELQKD<br>KMAEAYSEIGMKGERRRGKGHDGLYQGLSTATKDTYDALHMQALPPR |
| 543 | DIQMTQSPSSLSASVGDRVTITCQASQDIANYLNWYQQKPGKAPKLLIYDASNLETGVPSRFSGS<br>GSGTDFTFTISSLQPEDIATYYCQQHFNLPLTFGGGTKVEIKGGGGSGGGGSGGGGSGGGGSQIT<br>LKESGPTLVKPTQTLTLTCTFSGFSLSTSGVGVGWIRQPPGKALEWLALIYWNDEKRYSPSLKSR<br>LTITKDTSKNQVVLTMTNMDPVDTAVYYCAREGSHDYKSSNWEDPWGQGTLVTVSSLEPKSCDKT<br>HTCPPCPIYIWAPLAGTCGVLLLSLVITLYCKRGRKKLLYIFKQPEMRPVQTTQEEDGCSCREPE<br>EEEGGCELRVKFSRSADAPAYQQGQNQLYNELNLGRREEYDVLDKRRGRDPEMGGKPRRKNPQEG<br>LYNELQKDKMAEAYSEIGMKGERRRGKGHDGLYQGLSTATKDTYDALHMQALPPR |
| 544 | DIQMTQSPSSLSASVGDRVTITCQASQDIANYLNWYQQKPGKAPKLLIYDASNLETGVPSRFSGS<br>GSGTDFTFTISSLQPEDIATYYCQQHFNLPLTFGGGTKVEIKGGGGSGGGGSGGGGSGGGGSQIT<br>LKESGPTLVKPTQTLTLTCTFSGFSLSTSGVGVGWIRQPPGKALEWLALIYWNDEKRYSPSLKSR<br>LTITKDTSKNQVVLTMTNMDPVDTAVYYCAREGSHDYKSSNWEDPWGQGTLVTVSSLEPKSCDKT<br>HTCPPCPIYIWAPLAGTCGVLLLSLVITLYCRSKRSRLLHSDYMNMTPRRPGPTRKHYQPYAPPR<br>DFAAYRSRVKFSRSADAPAYQQGQNQLYNELNLGRREEYDVLDKRRGRDPEMGGKPRRKNPQEGL<br>YNELQKDKMAEAYSEIGMKGERRRGKGHDGLYQGLSTATKDTYDALHMQALPPR |
| 545 | DIQMTQSPSSLSASVGDRVTITCQASQDIANYLNWYQQKPGKAPKLLIYDASNLETGVPSRFSGS<br>GSGTDFTFTISSLQPEDIATYYCQQHFNLPLTFGGGTKVEIKGGGGSGGGGGGGGSGGGGSQIT<br>LKESGPTLVKPTQTLTLTCTFSGFSLSTSGVGVGWIRQPPGKALEWLALIYWNDEKRYSPSLKSR<br>LTITKDTSKNQVVLTMTNMDPVDTAVYYCAREGSHDYKSSNWEDPWGQGTLVTVSSLEPKSCDKT<br>HTCPPCPIYIWAPLAGTCGVLLLSLVITLYCTKKKYSSSVHDPNGEYMEMRAVNTAKKSRLTDVT<br>LRVKFSRSADAPAYQQGQNQLYNELNLGRREEYDVLDKRRGRDPEMGGKPRRKNPQEGLYNELQK<br>DKMAEAYSEIGMKGERRRGKGHDGLYQGLSTATKDTYDALHMQALPPR |
| 546 | DIQMTQSPSSLSASVGDRVTITCQASQDIANYLNWYQQKPGKAPKLLIYDASNLETGVPSRFSGS<br>GSGTDFTFTISSLQPEDIATYYCQQHFNLPLTFGGGTKVEIKGGGGSGGGGSGGGGSGGGGSQIT<br>LKESGPTLVKPTQTLTLTCTFSGFSLSTSGVGVGWIRQPPGKALEWLALIYWNDEKRYSPSLKSR |

-continued

| SEQ ID NO. | AMINO ACID SEQUENCE |
|---|---|
| | LTITKDTSKNQVVLTMTNMDPVDTAVYYCAREGSHDYKSSNWEDPWGQGTLVTVSSLEPKSCDKT HTCPPCPFWVLVVVGGVLACYSLLVTVAFIIFWVKRGRKKLLYIFKQPEMRPVQTTQEEDGCSCR FPEEEEGGCELRVKFSRSADAPAYQQGQNQLYNELNLGRREEYDVLDKRRGRDPEMGGKPRRKNP QEGLYNELQKDKMAEAYSEIGMKGERRRGKGHDGLYQGLSTATKDTYDALHMQALPPR |
| 547 | DIQMTQSPSSLSASVGDRVTITCQASQDIANYLNWYQQKPGKAPKLLIYDASNLETGVPSRFSGS GSGTDFTFTISSLQPEDIATYYCQQHFNLPLTFGGGTKVEIKGGGGSGGGGSGGGGSGGGGSQIT LKESGPTLVKPTQTLTLTCTFSGFSLSTSGVGVGWIRQPPGKALEWLALIYWNDEKRYSPSLKSR LTITKDTSKNQVVLTMTNMDPVDTAVYYCAREGSHDYKSSNWEDPWGQGTLVTVSSLEPKSCDKT HTCPPCPFWVLVVVGGVLACYSLLVTVAFIIFWVRSKRSRLLHSDYMNMTPRRPGPTRKHYQPYA PPRDFAAYRSRVKFSRSADAPAYQQGQNQLYNELNLGRREEYDVLDKRRGRDPEMGGKPRRKNPQ EGLYNELQKDKMAEAYSEIGMKGERRRGKGHDGLYQGLSTATKDTYDALHMQALPPR |
| 548 | DIQMTQSPSSLSASVGDRVTITCQASQDIANYLNWYQQKPGKAPKLLIYDASNLETGVPSRFSGS GSGTDFTFTISSLQPEDIATYYCQQHFNLPLTFGGGTKVEIKGGGGSGGGGSGGGGSGGGGSQIT LKESGPTLVKPTQTLTLTCTFSGFSLSTSGVGVGWIRQPPGKALEWLALIYWNDEKRYSPSLKSR LTITKDTSKNQVVLTMTNMDPVDTAVYYCAREGSHDYKSSNWEDPWGQGTLVTVSSLEPKSCDKT HTCPPCPFWVLVVVGGVLACYSLLVTVAFIIFWVTKKKYSSSVHDPNGEYMEMRAVNTAKKSRLT DVTLRVKFSRSADAPAYQQGQNQLYNELNLGRREEYDVLDKRRGRDPEMGGKPRRKNPQEGLYNE LQKDKMAEAYSEIGMKGERRRGKGHDGLYQGLSTATKDTYDALHMQALPPR |

In particular embodiments, a CAR comprises an antibody or antigen binding fragment thereof comprising an amino acid sequence set forth in SEQ ID NO: 99 or SEQ ID NO: 100; a spacer domain comprising an amino acid sequence set forth in SEQ ID NO: 145, SEQ ID NO: 146, SEQ ID NO: 148, or SEQ ID NO: 150; a transmembrane domain comprising an amino acid sequence set forth in SEQ ID NO: 151 or SEQ ID NO: 153; a costimulatory domain comprising an amino acid sequence set forth in SEQ ID NO: 159, SEQ ID NO: 160, or SEQ ID NO: 162; and a primary signaling domain comprising an amino acid sequence set forth in SEQ ID NO: 158. In particular embodiments, a CAR comprises an amino acid sequence set forth in any one of SEQ ID NOs: 549, 550, 551, 552, 553, 554, 555, 556, 557, 558, 559, 560, 561, 562, 563, 564, 565, 566, 567, 568, 569, 570, 571, and 572. In particular embodiments, a CAR comprises an amino acid sequence set forth in any one of SEQ ID NOs: 573, 574, 575, 576, 577, 578, 579, 580, 581, 582, 583, 584, 585, 586, 587, 588, 589, 590, 591, 592, 593, 594, 595, and 596.

| SEQ ID NO. | AMINO ACID SEQUENCE |
|---|---|
| 549 | EVQLVESGGGLVKPGGSLRLSCAASGFTFSSYSMNWVRQAPGKGLEWVSSISSSSSYIYYADSVK GRFTISRDNAKNSLYLQMNSLRAEDTAVYYCARAGDTYSAADYYYMDVWGKGTTVTVSSGGGGSG GGGSGGGGSGGGGSDIVMTQSPLSLPVTPGEPASISCRSSQSLLHSNGYNYLDWYLQKPGQSPQL LIYLGSNRASGVPDRFSGSGSGTDFTLKISRVEAEDVGVYYCMQALGLITFGGGTKVEIKTTTPA PRPPTPAPTIASQPLSLRPEACRPAAGGAVHTRGLDFACDIYIWAPLAGTCGVLLLSLVITLYCK RGRKKLLYIFKQPFMRPVQTTQEEDGCSCRFPEEEEGGCELRVKFSRSADAPAYQQGQNQLYNEL NLGRREEYDVLDKRRGRDPEMGGKPRRKNPQEGLYNELQKDKMAEAYSEIGMKGERRRGKGHDGL YQGLSTATKDTYDALHMQALPPR |
| 550 | EVQLVESGGGLVKPGGSLRLSCAASGFTFSSYSMNWVRQAPGKGLEWVSSISSSSSYIYYADSVK GRFTISRDNAKNSLYLQMNSLRAEDTAVYYCARAGDTYSAADYYYMDVWGKGTTVTVSSGGGGSG GGGSGGGGSGGGGSDIVMTQSPLSLPVTPGEPASISCRSSQSLLHSNGYNYLDWYLQKPGQSPQL LIYLGSNRASGVPDRFSGSGSGTDFTLKISRVEAEDVGVYYCMQALGLITFGGGTKVEIKTTTPA PRPPTPAPTIASQPLSLRPEACRPAAGGAVHTRGLDFACDIYIWAPLAGTCGVLLLSLVITLYCR SKRSRLLHSDYMNMTPRRPGPTRKHYQPYAPPRDFAAYRSRVKESRSADAPAYQQGQNQLYNELN LGRREEYDVLDKRRGRDPEMGGKPRRKNPQEGLYNELQKDKMAEAYSEIGMKGERRRGKGHDGLY QGLSTATKDTYDALHMQALPPR |
| 551 | EVQLVESGGGLVKPGGSLRLSCAASGFTFSSYSMNWVRQAPGKGLEWVSSISSSSSYIYYADSVK GRFTISRDNAKNSLYLQMNSLRAEDTAVYYCARAGDTYSAADYYYMDVWGKGTTVTVSSGGGGSG GGGSGGGGSGGGGSDIVMTQSPLSLPVTPGEPASISCRSSQSLLHSNGYNYLDWYLQKPGQSPQL LIYLGSNRASGVPDRFSGSGSGTDFTLKISRVEAEDVGVYYCMQALGLITFGGGTKVEIKTTTPA PRPPTPAPTIASQPLSLRPEACRPAAGGAVHTRGLDFACDIYIWAPLAGTCGVLLLSLVITLYCT KKKYSSSVHDPNGEYMEMRAVNTAKKSRLTDVTLRVKFSRSADAPAYQQGQNQLYNELNLGRREE YDVLDKRRGRDPEMGGKPRRKNPQEGLYNELQKDKMAEAYSEIGMKGERRRGKGHDGLYQGLSTA TKDTYDALHMQALPPR |
| 552 | EVQLVESGGGLVKPGGSLRLSCAASGFTFSSYSMNWVRQAPGKGLEWVSSISSSSSYIYYADSVK GRFTISRDNAKNSLYLQMNSLRAEDTAVYYCARAGDTYSAADYYYMDVWGKGTTVTVSSGGGGSG GGGSGGGGSGGGGSDIVMTQSPLSLPVTPGEPASISCRSSQSLLHSNGYNYLDWYLQKPGQSPQL LIYLGSNRASGVPDRFSGSGSGTDFTLKISRVEAEDVGVYYCMQALGLITFGGGTKVEIKTTTPA PRPPTPAPTIASQPLSLRPEACRPAAGGAVHTRGLDFACDFWVLVVVGGVLACYSLLVTVAFIIF WVKRGRKKLLYIFKQPFMRPVQTTQEEDGCSCRFPEEEEGGCELRVKFSRSADAPAYQQGQNQLY NELNLGRREEYDVLDKRRGRDPEMGGKPRRKNPQEGLYNELQKDKMAEAYSEIGMKGERRRGKGH DGLYQGLSTATKDTYDALHMQALPPR |

-continued

| SEQ ID NO. | AMINO ACID SEQUENCE |
|---|---|
| 553 | EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKESRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 554 | EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 555 | EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 556 | EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 557 | EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 558 | EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 559 | EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 560 | EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 561 | EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKESKYG |

-continued

| SEQ ID NO. | AMINO ACID SEQUENCE |
|---|---|
| | PPCPPCPIYIWAPLAGTCGVLLLSLVITLYCKRGRKKLLYIFKQPFMRPVQTTQEEDGCSCRFPE EEEGGCELRVKFSRSADAPAYQQGQNQLYNELNLGRREEYDVLDKRRGRDPEMGGKPRRKNPQEG LYNELQKDKMAEAYSEIGMKGERRRGKGHDGLYQGLSTATKDTYDALHMQALPPR |
| 562 | EVQLVESGGGLVKPGGSLRLSCAASGFTFSSYSMNWVRQAPGKGLEWVSSISSSSSYIYYADSVK GRFTISRDNAKNSLYLQMNSLRAEDTAVYYCARAGDTYSAADYYYMDVWGKGTTVTVSSGGGGSG GGGSGGGGSGGGGSDIVMTQSPLSLPVTPGEPASISCRSSQSLLHSNGYNYLDWYLQKPGQSPQL LIYLGSNRASGVPDRFSGSGSGTDFTLKISRVEAEDVGVYYCMQALGLITFGGGTKVEIKESKYG PPCPPCPIYIWAPLAGTCGVLLLSLVITLYCRSKRSRLLHSDYMNMTPRRPGPTRKHYQPYAPPR DFAAYRSRVKFSRSADAPAYQQGQNQLYNELNLGRREEYDVLDKRRGRDPEMGGKPRRKNPQEGL YNELQKDKMAEAYSEIGMKGERRRGKGHDGLYQGLSTATKDTYDALHMQALPPR |
| 563 | EVQLVESGGGLVKPGGSLRLSCAASGFTFSSYSMNWVRQAPGKGLEWVSSISSSSSYIYYADSVK GRFTISRDNAKNSLYLQMNSLRAEDTAVYYCARAGDTYSAADYYYMDVWGKGTTVTVSSGGGGSG GGGSGGGGSGGGGSDIVMTQSPLSLPVTPGEPASISCRSSQSLLHSNGYNYLDWYLQKPGQSPQL LIYLGSNRASGVPDRFSGSGSGTDFTLKISRVEAEDVGVYYCMQALGLITFGGGTKVEIKESKYG PPCPPCPIYIWAPLAGTCGVLLLSLVITLYCTKKKYSSSVHDPNGEYMEMRAVNTAKKSRLTDVT LRVKFSRSADAPAYQQGQNQLYNELNLGRREEYDVLDKRRGRDPEMGGKPRRKNPQEGLYNELQK DKMAEAYSEIGMKGERRRGKGHDGLYQGLSTATKDTYDALHMQALPPR |
| 564 | EVQLVESGGGLVKPGGSLRLSCAASGFTFSSYSMNWVRQAPGKGLEWVSSISSSSSYIYYADSVK GRFTISRDNAKNSLYLQMNSLRAEDTAVYYCARAGDTYSAADYYYMDVWGKGTTVTVSSGGGGSG GGGSGGGGSGGGGSDIVMTQSPLSLPVTPGEPASISCRSSQSLLHSNGYNYLDWYLQKPGQSPQL LIYLGSNRASGVPDRFSGSGSGTDFTLKISRVEAEDVGVYYCMQALGLITFGGGTKVEIKESKYG PPCPPCPFWVLVVVGGVLACYSLLVTVAFIIFWVKRGRKKLLYIFKQPFMRPVQTTQEEDGCSCR FPEEEEGGCELRVKFSRSADAPAYQQGQNQLYNELNLGRREEYDVLDKRRGRDPEMGGKPRRKNP QEGLYNELQKDKMAEAYSEIGMKGERRRGKGHDGLYQGLSTATKDTYDALHMQALPPR |
| 565 | EVQLVESGGGLVKPGGSLRLSCAASGFTFSSYSMNWVRQAPGKGLEWVSSISSSSSYIYYADSVK GRFTISRDNAKNSLYLQMNSLRAEDTAVYYCARAGDTYSAADYYYMDVWGKGTTVTVSSGGGGSG GGGSGGGGSGGGGSDIVMTQSPLSLPVTPGEPASISCRSSQSLLHSNGYNYLDWYLQKPGQSPQL LIYLGSNRASGVPDRFSGSGSGTDFTLKISRVEAEDVGVYYCMQALGLITFGGGTKVEIKESKYG PPCPPCPFWVLVVVGGVLACYSLLVTVAFIIFWVRSKRSRLLHSDYMNMTPRRPGPTRKHYQPYA PPRDFAAYRSRVKFSRSADAPAYQQGQNQLYNELNLGRREEYDVLDKRRGRDPEMGGKPRRKNPQ EGLYNELQKDKMAEAYSEIGMKGERRRGKGHDGLYQGLSTATKDTYDALHMQALPPR |
| 566 | EVQLVESGGGLVKPGGSLRLSCAASGFTFSSYSMNWVRQAPGKGLEWVSSISSSSSYIYYADSVK GRFTISRDNAKNSLYLQMNSLRAEDTAVYYCARAGDTYSAADYYYMDVWGKGTTVTVSSGGGGSG GGGSGGGGSGGGGSDIVMTQSPLSLPVTPGEPASISCRSSQSLLHSNGYNYLDWYLQKPGQSPQL LIYLGSNRASGVPDRFSGSGSGTDFTLKISRVEAEDVGVYYCMQALGLITFGGGTKVEIKESKYG PPCPPCPFWVLVVVGGVLACYSLLVTVAFIIFWVTKKKYSSSVHDPNGEYMEMRAVNTAKKSRLT DVTLRVKFSRSADAPAYQQGQNQLYNELNLGRREEYDVLDKRRGRDPEMGGKPRRKNPQEGLYNE LQKDKMAEAYSEIGMKGERRRGKGHDGLYQGLSTATKDTYDALHMQALPPR |
| 567 | EVQLVESGGGLVKPGGSLRLSCAASGFTFSSYSMNWVRQAPGKGLEWVSSISSSSSYIYYADSVK GRFTISRDNAKNSLYLQMNSLRAEDTAVYYCARAGDTYSAADYYYMDVWGKGTTVTVSSGGGGSG GGGSGGGGSGGGGSDIVMTQSPLSLPVTPGEPASISCRSSQSLLHSNGYNYLDWYLQKPGQSPQL LIYLGSNRASGVPDRFSGSGSGTDFTLKISRVEAEDVGVYYCMQALGLITFGGGTKVEIKLEPKS CDKTHTCPPCPIYIWAPLAGTCGVLLLSLVITLYCKRGRKKLLYIFKQPFMRPVQTTQEEDGCSC RFPEEEEGGCELRVKFSRSADAPAYQQGQNQLYNELNLGRREEYDVLDKRRGRDPEMGGKPRRKN PQEGLYNELQKDKMAEAYSEIGMKGERRRGKGHDGLYQGLSTATKDTYDALHMQALPPR |
| 568 | EVQLVESGGGLVKPGGSLRLSCAASGFTFSSYSMNWVRQAPGKGLEWVSSISSSSSYIYYADSVK GRFTISRDNAKNSLYLQMNSLRAEDTAVYYCARAGDTYSAADYYYMDVWGKGTTVTVSSGGGGSG GGGSGGGGSGGGGSDIVMTQSPLSLPVTPGEPASISCRSSQSLLHSNGYNYLDWYLQKPGQSPQL LIYLGSNRASGVPDRFSGSGSGTDFTLKISRVEAEDVGVYYCMQALGLITFGGGTKVEIKLEPKS CDKTHTCPPCPIYIWAPLAGTCGVLLLSLVITLYCRSKRSRLLHSDYMNMTPRRPGPTRKHYQPY APPRDFAAYRSRVKFSRSADAPAYQQGQNQLYNELNLGRREEYDVLDKRRGRDPEMGGKPRRKNP QEGLYNELQKDKMAEAYSEIGMKGERRRGKGHDGLYQGLSTATKDTYDALHMQALPPR |
| 569 | EVQLVESGGGLVKPGGSLRLSCAASGFTFSSYSMNWVRQAPGKGLEWVSSISSSSSYIYYADSVK GRFTISRDNAKNSLYLQMNSLRAEDTAVYYCARAGDTYSAADYYYMDVWGKGTTVTVSSGGGGSG GGGSGGGGSGGGGSDIVMTQSPLSLPVTPGEPASISCRSSQSLLHSNGYNYLDWYLQKPGQSPQL LIYLGSNRASGVPDRFSGSGSGTDFTLKISRVEAEDVGVYYCMQALGLITFGGGTKVEIKLEPKS CDKTHTCPPCPIYIWAPLAGTCGVLLLSLVITLYCTKKKYSSSVHDPNGEYMFMRAVNTAKKSRL TDVTLRVKFSRSADAPAYQQGQNQLYNELNLGRREEYDVLDKRRGRDPEMGGKPRRKNPQEGLYN ELQKDKMAEAYSEIGMKGERRRGKGHDGLYQGLSTATKDTYDALHMQALPPR |
| 570 | EVQLVESGGGLVKPGGSLRLSCAASGFTFSSYSMNWVRQAPGKGLEWVSSISSSSSYIYYADSVK GRFTISRDNAKNSLYLQMNSLRAEDTAVYYCARAGDTYSAADYYYMDVWGKGTTVTVSSGGGGSG GGGSGGGGSGGGGSDIVMTQSPLSLPVTPGEPASISCRSSQSLLHSNGYNYLDWYLQKPGQSPQL LIYLGSNRASGVPDRFSGSGSGTDFTLKISRVEAEDVGVYYCMQALGLITFGGGTKVEIKLEPKS CDKTHTCPPCPFWVLVVVGGVLACYSLLVTVAFIIFWVKRGRKKLLYIFKQPFMRPVQTTQEEDG CSCRFPEEEEGGCELRVKFSRSADAPAYQQGQNQLYNELNLGRREEYDVLDKRRGRDPEMGGKPR RKNPQEGLYNELQKDKMAEAYSEIGMKGERRRGKGHDGLYQGLSTATKDTYDALHMQALPPR |

-continued

| SEQ ID NO. | AMINO ACID SEQUENCE |
|---|---|
| 571 | EVQLVESGGGLVKPGGSLRLSCAASGFTFSSYSMNWVRQAPGKGLEWVSSISSSSSYIYYADSVK GRFTISRDNAKNSLYLQMNSLRAEDTAVYYCARAGDTYSAADYYYMDVWGKGTTVTVSSGGGGSG GGGSGGGGSGGGGSDIVMTQSPLSLPVTPGEPASISCRSSQSLLHSNGYNYLDWYLQKPGQSPQL LIYLGSNRASGVPDRFSGSGSGTDFTLKISRVEAEDVGVYYCMQALGLITFGGGTKVEIKLEPKS CDKTHTCPPCPFWVLVVVGGVLACYSLLVTVAFIIFWVRSKRSRLLHSDYMNMTPRRPGPTRKHY QPYAPPRDFAAYRSRVKFSRSADAPAYQQGQNQLYNELNLGRREEYDVLDKRRGRDPEMGGKPRR KNPQEGLYNELQKDKMAEAYSEIGMKGERRRGKGHDGLYQGLSTATKDTYDALHMQALPPR |
| 572 | EVQLVESGGGLVKPGGSLRLSCAASGFTFSSYSMNWVRQAPGKGLEWVSSISSSSSYIYYADSVK GRFTISRDNAKNSLYLQMNSLRAEDTAVYYCARAGDTYSAADYYYMDVWGKGTTVTVSSGGGGSG GGGSGGGGSGGGGSDIVMTQSPLSLPVTPGEPASISCRSSQSLLHSNGYNYLDWYLQKPGQSPQL LIYLGSNRASGVPDRFSGSGSGTDFTLKISRVEAEDVGVYYCMQALGLITFGGGTKVEIKLEPKS CDKTHTCPPCPFWVLVVVGGVLACYSLLVTVAFIIFWVTKKKYSSSVHDPNGEYMEMRAVNTAKK SRLTDVTLRVKFSRSADAPAYQQGQNQLYNELNLGRREEYDVLDKRRGRDPEMGGKPRRKNPQEG LYNELQKDKMAEAYSEIGMKGERRRGKGHDGLYQGLSTATKDTYDALHMQALPPR |
| 573 | DIVMTQSPLSLPVTPGEPASISCRSSQSLLHSNGYNYLDWYLQKPGQSPQLLIYLGSNRASGVPD RFSGSGSGTDFTLKISRVEAEDVGVYYCMQALGLITFGGGTKVEIKGGGGSGGGGSGGGGSGGGG SEVQLVESGGGLVKPGGSLRLSCAASGFTFSSYSMNWVRQAPGKGLEWVSSISSSSSYIYYADSV KGRFTISRDNAKNSLYLQMNSLRAEDTAVYYCARAGDTYSAADYYYMDVWGKGTTVTVSSTTTPA PRPPTPAPTIASQPLSLRPEACRPAAGGAVHTRGLDFACDIYIWAPLAGTCGVLLLSLVITLYCK RGRKKLLYIFKQPFMRPVQTTQEEDGCSCRFPEEEEGGCELRVKFSRSADAPAYQQGQNQLYNEL NLGRREEYDVLDKRRGRDPEMGGKPRRKNPQEGLYNELQKDKMAEAYSEIGMKGERRRGKGHDGL YQGLSTATKDTYDALHMQALPPR |
| 574 | DIVMTQSPLSLPVTPGEPASISCRSSQSLLHSNGYNYLDWYLQKPGQSPQLLIYLGSNRASGVPD RFSGSGSGTDFTLKISRVEAEDVGVYYCMQALGLITFGGGTKVEIKGGGGSGGGGSGGGGSGGGG SEVQLVESGGGLVKPGGSLRLSCAASGFTFSSYSMNWVRQAPGKGLEWVSSISSSSSYIYYADSV KGRFTISRDNAKNSLYLQMNSLRAEDTAVYYCARAGDTYSAADYYYMDVWGKGTTVTVSSTTTPA PRPPTPAPTIASQPLSLRPEACRPAAGGAVHTRGLDFACDIYIWAPLAGTCGVLLLSLVITLYCR SKRSRLLHSDYMNMTPRRPGPTRKHYQPYAPPRDFAAYRSRVKFSRSADAPAYQQGQNQLYNELN LGRREEYDVLDKRRGRDPEMGGKPRRKNPQEGLYNELQKDKMAEAYSEIGMKGERRRGKGHDGLY QGLSTATKDTYDALHMQALPPR |
| 575 | DIVMTQSPLSLPVTPGEPASISCRSSQSLLHSNGYNYLDWYLQKPGQSPQLLIYLGSNRASGVPD RFSGSGSGTDFTLKISRVEAEDVGVYYCMQALGLITFGGGTKVEIKGGGGSGGGGSGGGGSGGGG SEVQLVESGGGLVKPGGSLRLSCAASGFTFSSYSMNWVRQAPGKGLEWVSSISSSSSYIYYADSV KGRFTISRDNAKNSLYLQMNSLRAEDTAVYYCARAGDTYSAADYYYMDVWGKGTTVTVSSTTTPA PRPPTPAPTIASQPLSLRPEACRPAAGGAVHTRGLDFACDIYIWAPLAGTCGVLLLSLVITLYCT KKKYSSSVHDPNGEYMEMRAVNTAKKSRLTDVTLRVKFSRSADAPAYQQGQNQLYNELNLGRREE YDVLDKRRGRDPEMGGKPRRKNPQEGLYNELQKDKMAEAYSEIGMKGERRRGKGHDGLYQGLSTA TKDTYDALHMQALPPR |
| 576 | DIVMTQSPLSLPVTPGEPASISCRSSQSLLHSNGYNYLDWYLQKPGQSPQLLIYLGSNRASGVPD RFSGSGSGTDFTLKISRVEAEDVGVYYCMQALGLITFGGGTKVEIKGGGGSGGGGSGGGGSGGGG SEVQLVESGGGLVKPGGSLRLSCAASGFTFSSYSMNWVRQAPGKGLEWVSSISSSSSYIYYADSV KGRFTISRDNAKNSLYLQMNSLRAEDTAVYYCARAGDTYSAADYYYMDVWGKGTTVTVSSTTTPA PRPPTPAPTIASQPLSLRPEACRPAAGGAVHTRGLDFACDFWVLVVVGGVLACYSLLVTVAFIIF WVKRGRKKLLYIFKQPFMRPVQTTQEEDGCSCRFPEEEEGGCELRVKFSRSADAPAYQQGQNQLY NELNLGRREEYDVLDKRRGRDPEMGGKPRRKNPQEGLYNELQKDKMAEAYSEIGMKGERRRGKGH DGLYQGLSTATKDTYDALHMQALPPR |
| 577 | DIVMTQSPLSLPVTPGEPASISCRSSQSLLHSNGYNYLDWYLQKPGQSPQLLIYLGSNRASGVPD RFSGSGSGTDFTLKISRVEAEDVGVYYCMQALGLITFGGGTKVEIKGGGGSGGGGSGGGGSGGGG SEVQLVESGGGLVKPGGSLRLSCAASGFTFSSYSMNWVRQAPGKGLEWVSSISSSSSYIYYADSV KGRFTISRDNAKNSLYLQMNSLRAEDTAVYYCARAGDTYSAADYYYMDVWGKGTTVTVSSTTTPA PRPPTPAPTIASQPLSLRPEACRPAAGGAVHTRGLDFACDFWVLVVVGGVLACYSLLVTVAFIIF WVRSKRSRLLHSDYMNMTPRRPGPTRKHYQPYAPPRDFAAYRSRVKFSRSADAPAYQQGQNQLYN ELNLGRREEYDVLDKRRGRDPEMGGKPRRKNPQEGLYNELQKDKMAEAYSEIGMKGERRRGKGHD GLYQGLSTATKDTYDALHMQALPPR |
| 578 | DIVMTQSPLSLPVTPGEPASISCRSSQSLLHSNGYNYLDWYLQKPGQSPQLLIYLGSNRASGVPD RFSGSGSGTDFTLKISRVEAEDVGVYYCMQALGLITFGGGTKVEIKGGGGSGGGGSGGGGSGGGG SEVQLVESGGGLVKPGGSLRLSCAASGFTFSSYSMNWVRQAPGKGLEWVSSISSSSSYIYYADSV KGRFTISRDNAKNSLYLQMNSLRAEDTAVYYCARAGDTYSAADYYYMDVWGKGTTVTVSSTTTPA PRPPTPAPTIASQPLSLRPEACRPAAGGAVHTRGLDFACDFWVLVVVGGVLACYSLLVTVAFIIF WVTKKKYSSSVHDPNGEYMFMRAVNTAKKSRLTDVTLRVKFSRSADAPAYQQGQNQLYNELNLGR REEYDVLDKRRGRDPEMGGKPRRKNPQEGLYNELQKDKMAEAYSEIGMKGERRRGKGHDGLYQGL STATKDTYDALHMQALPPR |
| 579 | DIVMTQSPLSLPVTPGEPASISCRSSQSLLHSNGYNYLDWYLQKPGQSPQLLIYLGSNRASGVPD RFSGSGSGTDFTLKISRVEAEDVGVYYCMQALGLITFGGGTKVEIKGGGGSGGGGSGGGGSGGGG SEVQLVESGGGLVKPGGSLRLSCAASGFTFSSYSMNWVRQAPGKGLEWVSSISSSSSYIYYADSV KGRFTISRDNAKNSLYLQMNSLRAEDTAVYYCARAGDTYSAADYYYMDVWGKGTTVTVSSIEVMY PPPYLDNEKSNGTIIHVKGKHLCPSPLFPGPSKPIYIWAPLAGTCGVLLLSLVITLYCKRGRKKL LYIFKQPFMRPVQTTQEEDGCSCRFPEEEEGGCELRVKFSRSADAPAYQQGQNQLYNELNLGRRE |

-continued

| SEQ ID NO. | AMINO ACID SEQUENCE |
|---|---|
| | EYDVLDKRRGRDPEMGGKPRRKNPQEGLYNELQKDKMAEAYSEIGMKGERRRGKGHDGLYQGLST ATKDTYDALHMQALPPR |
| 580 | DIVMTQSPLSLPVTPGEPASISCRSSQSLLHSNGYNYLDWYLQKPGQSPQLLIYLGSNRASGVPD RFSGSGSGTDFTLKISRVEAEDVGVYYCMQALGLITFGGGTKVEIKGGGGSGGGGSGGGGSGGGG SEVQLVESGGGLVKPGGSLRLSCAASGFTFSSYSMNWVRQAPGKGLEWVSSISSSSSYIYYADSV KGRFTISRDNAKNSLYLQMNSLRAEDTAVYYCARAGDTYSAADYYYMDVWGKGTTVTVSSIEVMY PPPYLDNEKSNGTIIHVKGKHLCPSPLFPGPSKPIYIWAPLAGTCGVLLLSLVITLYCRSKRSRL LHSDYMNMTPRRPGPTRKHYQPYAPPRDFAAYRSRVKFSRSADAPAYQQGQNQLYNELNLGRREE YDVLDKRRGRDPEMGGKPRRKNPQEGLYNELQKDKMAEAYSEIGMKGERRRGKGHDGLYQGLSTA TKDTYDALHMQALPPR |
| 581 | DIVMTQSPLSLPVTPGEPASISCRSSQSLLHSNGYNYLDWYLQKPGQSPQLLIYLGSNRASGVPD RFSGSGSGTDFTLKISRVEAEDVGVYYCMQALGLITFGGGTKVEIKGGGGSGGGGSGGGGSGGGG SEVQLVESGGGLVKPGGSLRLSCAASGFTFSSYSMNWVRQAPGKGLEWVSSISSSSSYIYYADSV KGRFTISRDNAKNSLYLQMNSLRAEDTAVYYCARAGDTYSAADYYYMDVWGKGTTVTVSSIEVMY PPPYLDNEKSNGTIIHVKGKHLCPSPLFPGPSKPIYIWAPLAGTCGVLLLSLVITLYCTKKKYSS SVHDPNGEYMEMRAVNTAKKSRLTDVTLRVKFSRSADAPAYQQGQNQLYNELNLGRREEYDVLDK RRGRDPEMGGKPRRKNPQEGLYNELQKDKMAEAYSEIGMKGERRRGKGHDGLYQGLSTATKDTYD ALHMQALPPR |
| 582 | DIVMTQSPLSLPVTPGEPASISCRSSQSLLHSNGYNYLDWYLQKPGQSPQLLIYLGSNRASGVPD RFSGSGSGTDFTLKISRVEAEDVGVYYCMQALGLITFGGGTKVEIKGGGGSGGGGSGGGGSGGGG SEVQLVESGGGLVKPGGSLRLSCAASGFTFSSYSMNWVRQAPGKGLEWVSSISSSSSYIYYADSV KGRFTISRDNAKNSLYLQMNSLRAEDTAVYYCARAGDTYSAADYYYMDVWGKGTTVTVSSIEVMY PPPYLDNEKSNGTIIHVKGKHLCPSPLFPGPSKPFWVLVVVGGVLACYSLLVTVAFIIFWVKRGR KKLLYIFKQPFMRPVQTTQEEDGCSCRFPEEEEGGCELRVKFSRSADAPAYQQGQNQLYNELNLG RREEYDVLDKRRGRDPEMGGKPRRKNPQEGLYNELQKDKMAEAYSEIGMKGERRRGKGHDGLYQG LSTATKDTYDALHMQALPPR |
| 583 | DIVMTQSPLSLPVTPGEPASISCRSSQSLLHSNGYNYLDWYLQKPGQSPQLLIYLGSNRASGVPD RFSGSGSGTDFTLKISRVEAEDVGVYYCMQALGLITFGGGTKVEIKGGGGSGGGGSGGGGSGGGG SEVQLVESGGGLVKPGGSLRLSCAASGFTFSSYSMNWVRQAPGKGLEWVSSISSSSSYIYYADSV KGRFTISRDNAKNSLYLQMNSLRAEDTAVYYCARAGDTYSAADYYYMDVWGKGTTVTVSSIEVMY PPPYLDNEKSNGTIIHVKGKHLCPSPLFPGPSKPFWVLVVVGGVLACYSLLVTVAFIIFWVRSKR SRLLHSDYMNMTPRRPGPTRKHYQPYAPPRDFAAYRSRVKFSRSADAPAYQQGQNQLYNELNLGR REEYDVLDKRRGRDPEMGGKPRRKNPQEGLYNELQKDKMAEAYSEIGMKGERRRGKGHDGLYQGL STATKDTYDALHMQALPPR |
| 584 | DIVMTQSPLSLPVTPGEPASISCRSSQSLLHSNGYNYLDWYLQKPGQSPQLLIYLGSNRASGVPD RFSGSGSGTDFTLKISRVEAEDVGVYYCMQALGLITFGGGTKVEIKGGGGSGGGGSGGGGSGGGG SEVQLVESGGGLVKPGGSLRLSCAASGFTFSSYSMNWVRQAPGKGLEWVSSISSSSSYIYYADSV KGRFTISRDNAKNSLYLQMNSLRAEDTAVYYCARAGDTYSAADYYYMDVWGKGTTVTVSSIEVMY PPPYLDNEKSNGTIIHVKGKHLCPSPLFPGPSKPFWVLVVVGGVLACYSLLVTVAFIIFWVTKKK YSSSVHDPNGEYMFMRAVNTAKKSRLTDVTLRVKFSRSADAPAYQQGQNQLYNELNLGRREEYDV LDKRRGRDPEMGGKPRRKNPQEGLYNELQKDKMAEAYSEIGMKGERRRGKGHDGLYQGLSTATKD TYDALHMQALPPR |
| 585 | DIVMTQSPLSLPVTPGEPASISCRSSQSLLHSNGYNYLDWYLQKPGQSPQLLIYLGSNRASGVPD RFSGSGSGTDFTLKISRVEAEDVGVYYCMQALGLITFGGGTKVEIKGGGGSGGGGSGGGGSGGGG SEVQLVESGGGLVKPGGSLRLSCAASGFTFSSYSMNWVRQAPGKGLEWVSSISSSSSYIYYADSV KGRFTISRDNAKNSLYLQMNSLRAEDTAVYYCARAGDTYSAADYYYMDVWGKGTTVTVSSESKYG PPCPPCPIYIWAPLAGTCGVLLLSLVITLYCKRGRKKLLYIFKQPFMRPVQTTQEEDGCSCRFPE EEEGGCELRVKFSRSADAPAYQQGQNQLYNELNLGRREEYDVLDKRRGRDPEMGGKPRRKNPQEG LYNELQKDKMAEAYSEIGMKGERRRGKGHDGLYQGLSTATKDTYDALHMQALPPR |
| 586 | DIVMTQSPLSLPVTPGEPASISCRSSQSLLHSNGYNYLDWYLQKPGQSPQLLIYLGSNRASGVPD RFSGSGSGTDFTLKISRVEAEDVGVYYCMQALGLITFGGGTKVEIKGGGGSGGGGSGGGGSGGGG SEVQLVESGGGLVKPGGSLRLSCAASGFTFSSYSMNWVRQAPGKGLEWVSSISSSSSYIYYADSV KGRFTISRDNAKNSLYLQMNSLRAEDTAVYYCARAGDTYSAADYYYMDVWGKGTTVTVSSESKYG PPCPPCPIYIWAPLAGTCGVLLLSLVITLYCRSKRSRLLHSDYMNMTPRRPGPTRKHYQPYAPPR DFAAYRSRVKFSRSADAPAYQQGQNQLYNELNLGRREEYDVLDKRRGRDPEMGGKPRRKNPQEGL YNELQKDKMAEAYSEIGMKGERRRGKGHDGLYQGLSTATKDTYDALHMQALPPR |
| 587 | DIVMTQSPLSLPVTPGEPASISCRSSQSLLHSNGYNYLDWYLQKPGQSPQLLIYLGSNRASGVPD RFSGSGSGTDFTLKISRVEAEDVGVYYCMQALGLITFGGGTKVEIKGGGGSGGGGSGGGGSGGGG SEVQLVESGGGLVKPGGSLRLSCAASGFTFSSYSMNWVRQAPGKGLEWVSSISSSSSYIYYADSV KGRFTISRDNAKNSLYLQMNSLRAEDTAVYYCARAGDTYSAADYYYMDVWGKGTTVTVSSESKYG PPCPPCPIYIWAPLAGTCGVLLLSLVITLYCTKKKYSSSVHDPNGEYMEMRAVNTAKKSRLTDVT LRVKFSRSADAPAYQQGQNQLYNELNLGRREEYDVLDKRRGRDPEMGGKPRRKNPQEGLYNELQK DKMAEAYSEIGMKGERRRGKGHDGLYQGLSTATKDTYDALHMQALPPR |
| 588 | DIVMTQSPLSLPVTPGEPASISCRSSQSLLHSNGYNYLDWYLQKPGQSPQLLIYLGSNRASGVPD RFSGSGSGTDFTLKISRVEAEDVGVYYCMQALGLITFGGGTKVEIKGGGGSGGGGSGGGGSGGGG SEVQLVESGGGLVKPGGSLRLSCAASGFTFSSYSMNWVRQAPGKGLEWVSSISSSSSYIYYADSV KGRFTISRDNAKNSLYLQMNSLRAEDTAVYYCARAGDTYSAADYYYMDVWGKGTTVTVSSESKYG |

-continued

| SEQ ID NO. | AMINO ACID SEQUENCE |
|---|---|
| | PPCPPCPFWVLVVVGGVLACYSLLVTVAFIIFWVKRGRKKLLYIFKQPEMRPVQTTQEEDGCSCR FPEEEEGGCELRVKFSRSADAPAYQQGQNQLYNELNLGRREEYDVLDKRRGRDPEMGGKPRRKNP QEGLYNELQKDKMAEAYSEIGMKGERRRGKGHDGLYQGLSTATKDTYDALHMQALPPR |
| 589 | DIVMTQSPLSLPVTPGEPASISCRSSQSLLHSNGYNYLDWYLQKPGQSPQLLIYLGSNRASGVPD RFSGSGSGTDFTLKISRVEAEDVGVYYCMQALGLITFGGGTKVEIKGGGGSGGGGSGGGGSGGGG SEVQLVESGGGLVKPGGSLRLSCAASGFTFSSYSMNWVRQAPGKGLEWVSSISSSSSYIYYADSV KGRFTISRDNAKNSLYLQMNSLRAEDTAVYYCARAGDTYSAADYYYMDVWGKGTTVTVSSESKYG PPCPPCPFWVLVVVGGVLACYSLLVTVAFIIFWVRSKRSRLLHSDYMNMTPRRPGPTRKHYQPYA PPRDFAAYRSRVKFSRSADAPAYQQGQNQLYNELNLGRREEYDVLDKRRGRDPEMGGKPRRKNPQ EGLYNELQKDKMAEAYSEIGMKGERRRGKGHDGLYQGLSTATKDTYDALHMQALPPR |
| 590 | DIVMTQSPLSLPVTPGEPASISCRSSQSLLHSNGYNYLDWYLQKPGQSPQLLIYLGSNRASGVPD RFSGSGSGTDFTLKISRVEAEDVGVYYCMQALGLITFGGGTKVEIKGGGGSGGGGSGGGGSGGGG SEVQLVESGGGLVKPGGSLRLSCAASGFTFSSYSMNWVRQAPGKGLEWVSSISSSSSYIYYADSV KGRFTISRDNAKNSLYLQMNSLRAEDTAVYYCARAGDTYSAADYYYMDVWGKGTTVTVSSESKYG PPCPPCPFWVLVVVGGVLACYSLLVTVAFIIFWVTKKKYSSSVHDPNGEYMEMRAVNTAKKSRLT DVTLRVKFSRSADAPAYQQGQNQLYNELNLGRREEYDVLDKRRGRDPEMGGKPRRKNPQEGLYNE LQKDKMAEAYSEIGMKGERRRGKGHDGLYQGLSTATKDTYDALHMQALPPR |
| 591 | DIVMTQSPLSLPVTPGEPASISCRSSQSLLHSNGYNYLDWYLQKPGQSPQLLIYLGSNRASGVPD RFSGSGSGTDFTLKISRVEAEDVGVYYCMQALGLITFGGGTKVEIKGGGGSGGGGSGGGGSGGGG SEVQLVESGGGLVKPGGSLRLSCAASGFTFSSYSMNWVRQAPGKGLEWVSSISSSSSYIYYADSV KGRFTISRDNAKNSLYLQMNSLRAEDTAVYYCARAGDTYSAADYYYMDVWGKGTTVTVSSLEPKS CDKTHTCPPCPIYIWAPLAGTCGVLLLSLVITLYCKRGRKKLLYIFKQPFMRPVQTTQEEDGCSC RFPEEEEGGCELRVKFSRSADAPAYQQGQNQLYNELNLGRREEYDVLDKRRGRDPEMGGKPRRKN PQEGLYNELQKDKMAEAYSEIGMKGERRRGKGHDGLYQGLSTATKDTYDALHMQALPPR |
| 592 | DIVMTQSPLSLPVTPGEPASISCRSSQSLLHSNGYNYLDWYLQKPGQSPQLLIYLGSNRASGVPD RFSGSGSGTDFTLKISRVEAEDVGVYYCMQALGLITFGGGTKVEIKGGGGSGGGGSGGGGSGGGG SEVQLVESGGGLVKPGGSLRLSCAASGFTFSSYSMNWVRQAPGKGLEWVSSISSSSSYIYYADSV KGRFTISRDNAKNSLYLQMNSLRAEDTAVYYCARAGDTYSAADYYYMDVWGKGTTVTVSSLEPKS CDKTHTCPPCPIYIWAPLAGTCGVLLLSLVITLYCRSKRSRLLHSDYMNMTPRRPGPTRKHYQPY APPRDFAAYRSRVKFSRSADAPAYQQGQNQLYNELNLGRREEYDVLDKRRGRDPEMGGKPRRKNP QEGLYNELQKDKMAEAYSEIGMKGERRRGKGHDGLYQGLSTATKDTYDALHMQALPPR |
| 593 | DIVMTQSPLSLPVTPGEPASISCRSSQSLLHSNGYNYLDWYLQKPGQSPQLLIYLGSNRASGVPD RFSGSGSGTDFTLKISRVEAEDVGVYYCMQALGLITFGGGTKVEIKGGGGSGGGGSGGGGSGGGG SEVQLVESGGGLVKPGGSLRLSCAASGFTFSSYSMNWVRQAPGKGLEWVSSISSSSSYIYYADSV KGRFTISRDNAKNSLYLQMNSLRAEDTAVYYCARAGDTYSAADYYYMDVWGKGTTVTVSSLEPKS CDKTHTCPPCPIYIWAPLAGTCGVLLLSLVITLYCTKKKYSSSVHDPNGEYMEMRAVNTAKKSRL TDVTLRVKFSRSADAPAYQQGQNQLYNELNLGRREEYDVLDKRRGRDPEMGGKPRRKNPQEGLYN ELQKDKMAEAYSEIGMKGERRRGKGHDGLYQGLSTATKDTYDALHMQALPPR |
| 594 | DIVMTQSPLSLPVTPGEPASISCRSSQSLLHSNGYNYLDWYLQKPGQSPQLLIYLGSNRASGVPD RFSGSGSGTDFTLKISRVEAEDVGVYYCMQALGLITFGGGTKVEIKGGGGSGGGGSGGGGSGGGG SEVQLVESGGGLVKPGGSLRLSCAASGFTFSSYSMNWVRQAPGKGLEWVSSISSSSSYIYYADSV KGRFTISRDNAKNSLYLQMNSLRAEDTAVYYCARAGDTYSAADYYYMDVWGKGTTVTVSSLEPKS CDKTHTCPPCPFWVLVVVGGVLACYSLLVTVAFIIFWVKRGRKKLLYIFKQPEMRPVQTTQEEDG CSCRFPEEEEGGCELRVKFSRSADAPAYQQGQNQLYNELNLGRREEYDVLDKRRGRDPEMGGKPR RKNPQEGLYNELQKDKMAEAYSEIGMKGERRRGKGHDGLYQGLSTATKDTYDALHMQALPPR |
| 595 | DIVMTQSPLSLPVTPGEPASISCRSSQSLLHSNGYNYLDWYLQKPGQSPQLLIYLGSNRASGVPD RFSGSGSGTDFTLKISRVEAEDVGVYYCMQALGLITFGGGTKVEIKGGGGSGGGGSGGGGSGGGG SEVQLVESGGGLVKPGGSLRLSCAASGFTFSSYSMNWVRQAPGKGLEWVSSISSSSSYIYYADSV KGRFTISRDNAKNSLYLQMNSLRAEDTAVYYCARAGDTYSAADYYYMDVWGKGTTVTVSSLEPKS CDKTHTCPPCPFWVLVVVGGVLACYSLLVTVAFIIFWVRSKRSRLLHSDYMNMTPRRPGPTRKHY QPYAPPRDFAAYRSRVKFSRSADAPAYQQGQNQLYNELNLGRREEYDVLDKRRGRDPEMGGKPRR KNPQEGLYNELQKDKMAEAYSEIGMKGERRRGKGHDGLYQGLSTATKDTYDALHMQALPPR |
| 596 | DIVMTQSPLSLPVTPGEPASISCRSSQSLLHSNGYNYLDWYLQKPGQSPQLLIYLGSNRASGVPD RFSGSGSGTDFTLKISRVEAEDVGVYYCMQALGLITFGGGTKVEIKGGGGSGGGGSGGGGSGGGG SEVQLVESGGGLVKPGGSLRLSCAASGFTFSSYSMNWVRQAPGKGLEWVSSISSSSSYIYYADSV KGRFTISRDNAKNSLYLQMNSLRAEDTAVYYCARAGDTYSAADYYYMDVWGKGTTVTVSSLEPKS CDKTHTCPPCPFWVLVVVGGVLACYSLLVTVAFIIFWVTKKKYSSSVHDPNGEYMFMRAVNTAKK SRLTDVTLRVKFSRSADAPAYQQGQNQLYNELNLGRREEYDVLDKRRGRDPEMGGKPRRKNPQEG LYNELQKDKMAEAYSEIGMKGERRRGKGHDGLYQGLSTATKDTYDALHMQALPPR |

In preferred embodiments, a CAR comprises an antibody or antigen binding fragment thereof comprising an amino acid sequence set forth in SEQ ID NO: 101; a spacer domain comprising an amino acid sequence set forth in SEQ ID NO: 145, SEQ ID NO: 146, SEQ ID NO: 148, or SEQ ID NO: 150; a transmembrane domain comprising an amino acid sequence set forth in SEQ ID NO: 151 or SEQ ID NO: 153; a costimulatory domain comprising an amino acid sequence set forth in SEQ ID NO: 159, SEQ ID NO: 160, or SEQ ID NO: 162; and a primary signaling domain comprising an amino acid sequence set forth in SEQ ID NO: 158. In preferred embodiments, a CAR comprises an amino acid sequence set forth in any one of SEQ ID NOs: 597, 598, 599, 600, 601, 602, 603, 604, 605, 606, 607, 608, 609, 610, 611, 612, 613, 614, 615, 616, 617, 618, 619, and 620.

| SEQ ID NO. | AMINO ACID SEQUENCE |
|---|---|
| 597 | EVQLLESGGGLVQPGGSLRLSCAASGFTFGSEAMSWVRQAPGKERELVSAISGSGEVTYYADSVK<br>GRFTISRDNSKNTLYLQMNSLRAEDTAVYYCQRLVEAKRHWGQGTQVTVSSTTTPAPRPPTPAPT<br>IASQPLSLRPEACRPAAGGAVHTRGLDFACDIYIWAPLAGTCGVLLLSLVITLYCKRGRKKLLYI<br>FKQPFMRPVQTTQEEDGCSCRFPEEEEGGCELRVKFSRSADAPAYQQGQNQLYNELNLGRREEYD<br>VLDKRRGRDPEMGGKPRRKNPQEGLYNELQKDKMAEAYSEIGMKGERRRGKGHDGLYQGLSTATK<br>DTYDALHMQALPPR |
| 598 | EVQLLESGGGLVQPGGSLRLSCAASGFTFGSEAMSWVRQAPGKERELVSAISGSGEVTYYADSVK<br>GRFTISRDNSKNTLYLQMNSLRAEDTAVYYCQRLVEAKRHWGQGTQVTVSSTTTPAPRPPTPAPT<br>IASQPLSLRPEACRPAAGGAVHTRGLDFACDIYIWAPLAGTCGVLLLSLVITLYCRSKRSRLLHS<br>DYMNMTPRRPGPTRKHYQPYAPPRDFAAYRSRVKFSRSADAPAYQQGQNQLYNELNLGRREEYDV<br>LDKRRGRDPEMGGKPRRKNPQEGLYNELQKDKMAEAYSEIGMKGERRRGKGHDGLYQGLSTATKD<br>TYDALHMQALPPR |
| 599 | EVQLLESGGGLVQPGGSLRLSCAASGFTFGSEAMSWVRQAPGKERELVSAISGSGEVTYYADSVK<br>GRFTISRDNSKNTLYLQMNSLRAEDTAVYYCQRLVEAKRHWGQGTQVTVSSTTTPAPRPPTPAPT<br>IASQPLSLRPEACRPAAGGAVHTRGLDFACDIYIWAPLAGTCGVLLLSLVITLYCTKKKYSSSVH<br>DPNGEYMFMRAVNTAKKSRLTDVTLRVKFSRSADAPAYQQGQNQLYNELNLGRREEYDVLDKRRG<br>RDPEMGGKPRRKNPQEGLYNELQKDKMAEAYSEIGMKGERRRGKGHDGLYQGLSTATKDTYDALH<br>MQALPPR |
| 600 | EVQLLESGGGLVQPGGSLRLSCAASGFTFGSEAMSWVRQAPGKERELVSAISGSGEVTYYADSVK<br>GRFTISRDNSKNTLYLQMNSLRAEDTAVYYCQRLVEAKRHWGQGTQVTVSSTTTPAPRPPTPAPT<br>IASQPLSLRPEACRPAAGGAVHTRGLDFACDFWVLVVVGGVLACYSLLVTVAFIIFWVKRGRKKL<br>LYIFKQPFMRPVQTTQEEDGCSCRFPEEEEGGCELRVKFSRSADAPAYQQGQNQLYNELNLGRRE<br>EYDVLDKRRGRDPEMGGKPRRKNPQEGLYNELQKDKMAEAYSEIGMKGERRRGKGHDGLYQGLST<br>ATKDTYDALHMQALPPR |
| 601 | EVQLLESGGGLVQPGGSLRLSCAASGFTFGSEAMSWVRQAPGKERELVSAISGSGEVTYYADSVK<br>GRFTISRDNSKNTLYLQMNSLRAEDTAVYYCQRLVEAKRHWGQGTQVTVSSTTTPAPRPPTPAPT<br>IASQPLSLRPEACRPAAGGAVHTRGLDFACDFWVLVVVGGVLACYSLLVTVAFIIFWVRSKRSRL<br>LHSDYMNMTPRRPGPTRKHYQPYAPPRDFAAYRSRVKFSRSADAPAYQQGQNQLYNELNLGRREE<br>YDVLDKRRGRDPEMGGKPRRKNPQEGLYNELQKDKMAEAYSEIGMKGERRRGKGHDGLYQGLSTA<br>TKDTYDALHMQALPPR |
| 602 | EVQLLESGGGLVQPGGSLRLSCAASGFTFGSEAMSWVRQAPGKERELVSAISGSGEVTYYADSVK<br>GRFTISRDNSKNTLYLQMNSLRAEDTAVYYCQRLVEAKRHWGQGTQVTVSSTTTPAPRPPTPAPT<br>IASQPLSLRPEACRPAAGGAVHTRGLDFACDEWVLVVVGGVLACYSLLVTVAFIIFWVTKKKYSS<br>SVHDPNGEYMEMRAVNTAKKSRLTDVTLRVKFSRSADAPAYQQGQNQLYNELNLGRREEYDVLDK<br>RRGRDPEMGGKPRRKNPQEGLYNELQKDKMAEAYSEIGMKGERRRGKGHDGLYQGLSTATKDTYD<br>ALHMQALPPR |
| 603 | EVQLLESGGGLVQPGGSLRLSCAASGFTFGSEAMSWVRQAPGKERELVSAISGSGEVTYYADSVK<br>GRFTISRDNSKNTLYLQMNSLRAEDTAVYYCQRLVEAKRHWGQGTQVTVSSIEVMYPPPYLDNEK<br>SNGTIIHVKGKHLCPSPLFPGPSKPIYIWAPLAGTCGVLLLSLVITLYCKRGRKKLLYIFKQPEM<br>RPVQTTQEEDGCSCRFPEEEEGGCELRVKFSRSADAPAYQQGQNQLYNELNLGRREEYDVLDKRR<br>GRDPEMGGKPRRKNPQEGLYNELQKDKMAEAYSEIGMKGERRRGKGHDGLYQGLSTATKDTYDAL<br>HMQALPPR |
| 604 | EVQLLESGGGLVQPGGSLRLSCAASGFTFGSEAMSWVRQAPGKERELVSAISGSGEVTYYADSVK<br>GRFTISRDNSKNTLYLQMNSLRAEDTAVYYCQRLVEAKRHWGQGTQVTVSSIEVMYPPPYLDNEK<br>SNGTIIHVKGKHLCPSPLFPGPSKPIYIWAPLAGTCGVLLLSLVITLYCRSKRSRLLHSDYMNMT<br>PRRPGPTRKHYQPYAPPRDFAAYRSRVKFSRSADAPAYQQGQNQLYNELNLGRREEYDVLDKRRG<br>RDPEMGGKPRRKNPQEGLYNELQKDKMAEAYSEIGMKGERRRGKGHDGLYQGLSTATKDTYDALH<br>MQALPPR |
| 605 | EVQLLESGGGLVQPGGSLRLSCAASGFTFGSEAMSWVRQAPGKERELVSAISGSGEVTYYADSVK<br>GRFTISRDNSKNTLYLQMNSLRAEDTAVYYCQRLVEAKRHWGQGTQVTVSSIEVMYPPPYLDNEK<br>SNGTIIHVKGKHLCPSPLFPGPSKPIYIWAPLAGTCGVLLLSLVITLYCTKKKYSSSVHDPNGEY<br>MFMRAVNTAKKSRLTDVTLRVKFSRSADAPAYQQGQNQLYNELNLGRREEYDVLDKRRGRDPEMG<br>GKPRRKNPQEGLYNELQKDKMAEAYSEIGMKGERRRGKGHDGLYQGLSTATKDTYDALHMQALPP<br>R |
| 606 | EVQLLESGGGLVQPGGSLRLSCAASGFTFGSEAMSWVRQAPGKERELVSAISGSGEVTYYADSVK<br>GRFTISRDNSKNTLYLQMNSLRAEDTAVYYCQRLVEAKRHWGQGTQVTVSSIEVMYPPPYLDNEK<br>SNGTIIHVKGKHLCPSPLFPGPSKPFWVLVVVGGVLACYSLLVTVAFIIFWVKRGRKKLLYIFKQ<br>PFMRPVQTTQEEDGCSCRFPEEEEGGCELRVKFSRSADAPAYQQGQNQLYNELNLGRREEYDVLD |

-continued

| SEQ ID NO. | AMINO ACID SEQUENCE |
|---|---|
| | KRRGRDPEMGGKPRRKNPQEGLYNELQKDKMAEAYSEIGMKGERRRGKGHDGLYQGLSTATKDTY DALHMQALPPR |
| 607 | EVQLLESGGGLVQPGGSLRLSCAASGFTFGSEAMSWVRQAPGKERELVSAISGSGEVTYYADSVK GRFTISRDNSKNTLYLQMNSLRAEDTAVYYCQRLVEAKRHWGQGTQVTVSSIEVMYPPPYLDNEK SNGTIIHVKGKHLCPSPLFPGPSKPFWVLVVVGGVLACYSLLVTVAFIIFWVRSKRSRLLHSDYM NMTPRRPGPTRKHYQPYAPPRDFAAYRSRVKFSRSADAPAYQQGQNQLYNELNLGRREEYDVLDK RRGRDPEMGGKPRRKNPQEGLYNELQKDKMAEAYSEIGMKGERRRGKGHDGLYQGLSTATKDTYD ALHMQALPPR |
| 608 | EVQLLESGGGLVQPGGSLRLSCAASGFTFGSEAMSWVRQAPGKERELVSAISGSGEVTYYADSVK GRFTISRDNSKNTLYLQMNSLRAEDTAVYYCQRLVEAKRHWGQGTQVTVSSIEVMYPPPYLDNEK SNGTIIHVKGKHLCPSPLFPGPSKPFWVLVVVGGVLACYSLLVTVAFIIFWVTKKKYSSSVHDPN GEYMFMRAVNTAKKSRLTDVTLRVKFSRSADAPAYQQGQNQLYNELNLGRREEYDVLDKRRGRDP EMGGKPRRKNPQEGLYNELQKDKMAEAYSEIGMKGERRRGKGHDGLYQGLSTATKDTYDALHMQA LPPR |
| 609 | EVQLLESGGGLVQPGGSLRLSCAASGFTFGSEAMSWVRQAPGKERELVSAISGSGEVTYYADSVK GRFTISRDNSKNTLYLQMNSLRAEDTAVYYCQRLVEAKRHWGQGTQVTVSSESKYGPPCPPCPIY IWAPLAGTCGVLLLSLVITLYCKRGRKKLLYIFKQPFMRPVQTTQEEDGCSCRFPEEEEGGCELR VKFSRSADAPAYQQGQNQLYNELNLGRREEYDVLDKRRGRDPEMGGKPRRKNPQEGLYNELQKDK MAEAYSEIGMKGERRRGKGHDGLYQGLSTATKDTYDALHMQALPPR |
| 610 | EVQLLESGGGLVQPGGSLRLSCAASGFTFGSEAMSWVRQAPGKERELVSAISGSGEVTYYADSVK GRFTISRDNSKNTLYLQMNSLRAEDTAVYYCQRLVEAKRHWGQGTQVTVSSESKYGPPCPPCPIY IWAPLAGTCGVLLLSLVITLYCRSKRSRLLHSDYMNMTPRRPGPTRKHYQPYAPPRDFAAYRSRV KFSRSADAPAYQQGQNQLYNELNLGRREEYDVLDKRRGRDPEMGGKPRRKNPQEGLYNELQKDKM AEAYSEIGMKGERRRGKGHDGLYQGLSTATKDTYDALHMQALPPR |
| 611 | EVQLLESGGGLVQPGGSLRLSCAASGFTFGSEAMSWVRQAPGKERELVSAISGSGEVTYYADSVK GRFTISRDNSKNTLYLQMNSLRAEDTAVYYCQRLVEAKRHWGQGTQVTVSSESKYGPPCPPCPIY IWAPLAGTCGVLLLSLVITLYCTKKKYSSSVHDPNGEYMFMRAVNTAKKSRLTDVTLRVKFSRSA DAPAYQQGQNQLYNELNLGRREEYDVLDKRRGRDPEMGGKPRRKNPQEGLYNELQKDKMAEAYSE IGMKGERRRGKGHDGLYQGLSTATKDTYDALHMQALPPR |
| 612 | EVQLLESGGGLVQPGGSLRLSCAASGFTFGSEAMSWVRQAPGKERELVSAISGSGEVTYYADSVK GRFTISRDNSKNTLYLQMNSLRAEDTAVYYCQRLVEAKRHWGQGTQVTVSSESKYGPPCPPCPFW VLVVVGGVLACYSLLVTVAFIIFWVKRGRKKLLYIFKQPFMRPVQTTQEEDGCSCRFPEEEEGGC ELRVKFSRSADAPAYQQGQNQLYNELNLGRREEYDVLDKRRGRDPEMGGKPRRKNPQEGLYNELQ KDKMAEAYSEIGMKGERRRGKGHDGLYQGLSTATKDTYDALHMQALPPR |
| 613 | EVQLLESGGGLVQPGGSLRLSCAASGFTFGSEAMSWVRQAPGKERELVSAISGSGEVTYYADSVK GRFTISRDNSKNTLYLQMNSLRAEDTAVYYCQRLVEAKRHWGQGTQVTVSSESKYGPPCPPCPFW VLVVVGGVLACYSLLVTVAFIIFWVRSKRSRLLHSDYMNMTPRRPGPTRKHYQPYAPPRDFAAYR SRVKFSRSADAPAYQQGQNQLYNELNLGRREEYDVLDKRRGRDPEMGGKPRRKNPQEGLYNELQK DKMAEAYSEIGMKGERRRGKGHDGLYQGLSTATKDTYDALHMQALPPR |
| 614 | EVQLLESGGGLVQPGGSLRLSCAASGFTFGSEAMSWVRQAPGKERELVSAISGSGEVTYYADSVK GRFTISRDNSKNTLYLQMNSLRAEDTAVYYCQRLVEAKRHWGQGTQVTVSSESKYGPPCPPCPFW VLVVVGGVLACYSLLVTVAFIIFWVTKKKYSSSVHDPNGEYMFMRAVNTAKKSRLTDVTLRVKFS RSADAPAYQQGQNQLYNELNLGRREEYDVLDKRRGRDPEMGGKPRRKNPQEGLYNELQKDKMAEA YSEIGMKGERRRGKGHDGLYQGLSTATKDTYDALHMQALPPR |
| 615 | EVQLLESGGGLVQPGGSLRLSCAASGFTFGSEAMSWVRQAPGKERELVSAISGSGEVTYYADSVK GRFTISRDNSKNTLYLQMNSLRAEDTAVYYCQRLVEAKRHWGQGTQVTVSSLEPKSCDKTHTCPP CPIYIWAPLAGTCGVLLLSLVITLYCKRGRKKLLYIFKQPFMRPVQTTQEEDGCSCRFPEEEEGG CELRVKFSRSADAPAYQQGQNQLYNELNLGRREEYDVLDKRRGRDPEMGGKPRRKNPQEGLYNEL QKDKMAEAYSEIGMKGERRRGKGHDGLYQGLSTATKDTYDALHMQALPPR |
| 616 | EVQLLESGGGLVQPGGSLRLSCAASGFTFGSEAMSWVRQAPGKERELVSAISGSGEVTYYADSVK GRFTISRDNSKNTLYLQMNSLRAEDTAVYYCQRLVEAKRHWGQGTQVTVSSLEPKSCDKTHTCPP CPIYIWAPLAGTCGVLLLSLVITLYCRSKRSRLLHSDYMNMTPRRPGPTRKHYQPYAPPRDFAAY RSRVKFSRSADAPAYQQGQNQLYNELNLGRREEYDVLDKRRGRDPEMGGKPRRKNPQEGLYNELQ KDKMAEAYSEIGMKGERRRGKGHDGLYQGLSTATKDTYDALHMQALPPR |
| 617 | EVQLLESGGGLVQPGGSLRLSCAASGFTFGSEAMSWVRQAPGKERELVSAISGSGEVTYYADSVK GRFTISRDNSKNTLYLQMNSLRAEDTAVYYCQRLVEAKRHWGQGTQVTVSSLEPKSCDKTHTCPP CPIYIWAPLAGTCGVLLLSLVITLYCTKKKYSSSVHDPNGEYMFMRAVNTAKKSRLTDVTLRVKF SRSADAPAYQQGQNQLYNELNLGRREEYDVLDKRRGRDPEMGGKPRRKNPQEGLYNELQKDKMAE AYSEIGMKGERRRGKGHDGLYQGLSTATKDTYDALHMQALPPR |
| 618 | EVQLLESGGGLVQPGGSLRLSCAASGFTFGSEAMSWVRQAPGKERELVSAISGSGEVTYYADSVK GRFTISRDNSKNTLYLQMNSLRAEDTAVYYCQRLVEAKRHWGQGTQVTVSSLEPKSCDKTHTCPP CPFWVLVVVGGVLACYSLLVTVAFIIFWVKRGRKKLLYIFKQPFMRPVQTTQEEDGCSCRFPEEE EGGCELRVKFSRSADAPAYQQGQNQLYNELNLGRREEYDVLDKRRGRDPEMGGKPRRKNPQEGLY NELQKDKMAEAYSEIGMKGERRRGKGHDGLYQGLSTATKDTYDALHMQALPPR |

-continued

| SEQ ID NO. | AMINO ACID SEQUENCE |
|---|---|
| 619 | EVQLLESGGGLVQPGGSLRLSCAASGFTFGSEAMSWVRQAPGKERELVSAISGSGEVTYYADSVK GRFTISRDNSKNTLYLQMNSLRAEDTAVYYCQRLVEAKRHWGQGTQVTVSSLEPKSCDKTHTCPP CPFWVLVVVGGVLACYSLLVTVAFIIFWVRSKRSRLLHSDYMNMTPRRPGPTRKHYQPYAPPRDE AAYRSRVKFSRSADAPAYQQGQNQLYNELNLGRREEYDVLDKRRGRDPEMGGKPRRKNPQEGLYN ELQKDKMAEAYSEIGMKGERRRGKGHDGLYQGLSTATKDTYDALHMQALPPR |
| 620 | EVQLLESGGGLVQPGGSLRLSCAASGFTFGSEAMSWVRQAPGKERELVSAISGSGEVTYYADSVK GRFTISRDNSKNTLYLQMNSLRAEDTAVYYCQRLVEAKRHWGQGTQVTVSSLEPKSCDKTHTCPP CPFWVLVVVGGVLACYSLLVTVAFIIFWVTKKKYSSSVHDPNGEYMEMRAVNTAKKSRLTDVTLR VKFSRSADAPAYQQGQNQLYNELNLGRREEYDVLDKRRGRDPEMGGKPRRKNPQEGLYNELQKDK MAEAYSEIGMKGERRRGKGHDGLYQGLSTATKDTYDALHMQALPPR |

In particular embodiments, a CAR comprises an antibody or antigen binding fragment thereof comprising an amino acid sequence set forth in SEQ ID NO: 105; a spacer domain comprising an amino acid sequence set forth in SEQ ID NO: 145, SEQ ID NO: 146, SEQ ID NO: 148, or SEQ ID NO: 150; a transmembrane domain comprising an amino acid sequence set forth in SEQ ID NO: 151 or SEQ ID NO: 153; a costimulatory domain comprising an amino acid sequence set forth in SEQ ID NO: 159, SEQ ID NO: 160, or SEQ ID NO: 162; and a primary signaling domain comprising an amino acid sequence set forth in SEQ ID NO: 158. In particular embodiments, a CAR comprises an amino acid sequence set forth in any one of SEQ ID NOs: 621, 622, 623, 624, 625, 626, 627, 628, 629, 630, 631, 632, 633, 634, 635, 636, 637, 638, 639, 640, 641, 642, 643, and 644.

| SEQ ID NO. | AMINO ACID SEQUENCE |
|---|---|
| 621 | EVQLLESGGGLVQPGGSLRLSCAASGFTFESEAMSWYRQAPGKERELVSVITSEGSTYYADSVKG RFTISRDNSKNTLYLQMNSLRAEDTAVYYCAHIEWETRLNWGQGTQVTVSSTTTPAPRPPTPAPT IASQPLSLRPEACRPAAGGAVHTRGLDFACDIYIWAPLAGTCGVLLLSLVITLYCKRGRKKLLYI FKQPFMRPVQTTQEEDGCSCRFPEEEEGGCELRVKESRSADAPAYQQGQNQLYNELNLGRREEYD VLDKRRGRDPEMGGKPRRKNPQEGLYNELQKDKMAEAYSEIGMKGERRRGKGHDGLYQGLSTATK DTYDALHMQALPPR |
| 622 | EVQLLESGGGLVQPGGSLRLSCAASGFTFESEAMSWYRQAPGKERELVSVITSEGSTYYADSVKG RFTISRDNSKNTLYLQMNSLRAEDTAVYYCAHIEWETRLNWGQGTQVTVSSTTTPAPRPPTPAPT IASQPLSLRPEACRPAAGGAVHTRGLDFACDIYIWAPLAGTCGVLLLSLVITLYCRSKRSRLLHS DYMNMTPRRPGPTRKHYQPYAPPRDFAAYRSRVKFSRSADAPAYQQGQNQLYNELNLGRREEYDV LDKRRGRDPEMGGKPRRKNPQEGLYNELQKDKMAEAYSEIGMKGERRRGKGHDGLYQGLSTATKD TYDALHMQALPPR |
| 623 | EVQLLESGGGLVQPGGSLRLSCAASGFTFESEAMSWYRQAPGKERELVSVITSEGSTYYADSVKG RFTISRDNSKNTLYLQMNSLRAEDTAVYYCAHIEWETRLNWGQGTQVTVSSTTTPAPRPPTPAPT IASQPLSLRPEACRPAAGGAVHTRGLDFACDIYIWAPLAGTCGVLLLSLVITLYCTKKKYSSSVH DPNGEYMEMRAVNTAKKSRLTDVTLRVKFSRSADAPAYQQGQNQLYNELNLGRREEYDVLDKRRG RDPEMGGKPRRKNPQEGLYNELQKDKMAEAYSEIGMKGERRRGKGHDGLYQGLSTATKDTYDALH MQALPPR |
| 624 | EVQLLESGGGLVQPGGSLRLSCAASGFTFESEAMSWYRQAPGKERELVSVITSEGSTYYADSVKG RFTISRDNSKNTLYLQMNSLRAEDTAVYYCAHIEWETRLNWGQGTQVTVSSTTTPAPRPPTPAPT IASQPLSLRPEACRPAAGGAVHTRGLDFACDFWVLVVVGGVLACYSLLVTVAFIIFWVKRGRKKL LYIFKQPFMRPVQTTQEEDGCSCRFPEEEEGGCELRVKFSRSADAPAYQQGQNQLYNELNLGRRE EYDVLDKRRGRDPEMGGKPRRKNPQEGLYNELQKDKMAEAYSEIGMKGERRRGKGHDGLYQGLST ATKDTYDALHMQALPPR |
| 625 | EVQLLESGGGLVQPGGSLRLSCAASGFTFESEAMSWYRQAPGKERELVSVITSEGSTYYADSVKG RFTISRDNSKNTLYLQMNSLRAEDTAVYYCAHIEWETRLNWGQGTQVTVSSTTTPAPRPPTPAPT IASQPLSLRPEACRPAAGGAVHTRGLDFACDFWVLVVVGGVLACYSLLVTVAFIIFWVRSKRSRL LHSDYMNMTPRRPGPTRKHYQPYAPPRDFAAYRSRVKFSRSADAPAYQQGQNQLYNELNLGRREE YDVLDKRRGRDPEMGGKPRRKNPQEGLYNELQKDKMAEAYSEIGMKGERRRGKGHDGLYQGLSTA TKDTYDALHMQALPPR |
| 626 | EVQLLESGGGLVQPGGSLRLSCAASGFTFESEAMSWYRQAPGKERELVSVITSEGSTYYADSVKG RFTISRDNSKNTLYLQMNSLRAEDTAVYYCAHIEWETRLNWGQGTQVTVSSTTTPAPRPPTPAPT IASQPLSLRPEACRPAAGGAVHTRGLDFACDFWVLVVVGGVLACYSLLVTVAFIIFWVTKKKYSS SVHDPNGEYMFMRAVNTAKKSRLTDVTLRVKFSRSADAPAYQQGQNQLYNELNLGRREEYDVLDK RRGRDPEMGGKPRRKNPQEGLYNELQKDKMAEAYSEIGMKGERRRGKGHDGLYQGLSTATKDTYD ALHMQALPPR |
| 627 | EVQLLESGGGLVQPGGSLRLSCAASGFTFESEAMSWYRQAPGKERELVSVITSEGSTYYADSVKG RFTISRDNSKNTLYLQMNSLRAEDTAVYYCAHIEWETRLNWGQGTQVTVSSIEVMYPPPYLDNEK SNGTIIHVKGKHLCPSPLFPGPSKPIYIWAPLAGTCGVLLLSLVITLYCKRGRKKLLYIFKQPFM |

-continued

| SEQ ID NO. | AMINO ACID SEQUENCE |
|---|---|
| | RPVQTTQEEDGCSCRFPEEEEGGCELRVKFSRSADAPAYQQGQNQLYNELNLGRREEYDVLDKRR GRDPEMGGKPRRKNPQEGLYNELQKDKMAEAYSEIGMKGERRRGKGHDGLYQGLSTATKDTYDAL HMQALPPR |
| 628 | EVQLLESGGGLVQPGGSLRLSCAASGFTFESEAMSWYRQAPGKERELVSVITSEGSTYYADSVKG RFTISRDNSKNTLYLQMNSLRAEDTAVYYCAHIEWETRLNWGQGTQVTVSSIEVMYPPPYLDNEK SNGTIIHVKGKHLCPSPLFPGPSKPIYIWAPLAGTCGVLLLSLVITLYCRSKRSRLLHSDYMNMT PRRPGPTRKHYQPYAPPRDFAAYRSRVKFSRSADAPAYQQGQNQLYNELNLGRREEYDVLDKRRG RDPEMGGKPRRKNPQEGLYNELQKDKMAEAYSEIGMKGERRRGKGHDGLYQGLSTATKDTYDALH MQALPPR |
| 629 | EVQLLESGGGLVQPGGSLRLSCAASGFTFESEAMSWYRQAPGKERELVSVITSEGSTYYADSVKG RFTISRDNSKNTLYLQMNSLRAEDTAVYYCAHIEWETRLNWGQGTQVTVSSIEVMYPPPYLDNEK SNGTIIHVKGKHLCPSPLFPGPSKPIYIWAPLAGTCGVLLLSLVITLYCTKKKYSSSVHDPNGEY MEMRAVNTAKKSRLTDVTLRVKFSRSADAPAYQQGQNQLYNELNLGRREEYDVLDKRRGRDPEMG GKPRRKNPQEGLYNELQKDKMAEAYSEIGMKGERRRGKGHDGLYQGLSTATKDTYDALHMQALPP R |
| 630 | EVQLLESGGGLVQPGGSLRLSCAASGFTFESEAMSWYRQAPGKERELVSVITSEGSTYYADSVKG RFTISRDNSKNTLYLQMNSLRAEDTAVYYCAHIEWETRLNWGQGTQVTVSSIEVMYPPPYLDNEK SNGTIIHVKGKHLCPSPLFPGPSKPFWVLVVVGGVLACYSLLVTVAFIIFWVKRGRKKLLYIFKQ PFMRPVQTTQEEDGCSCRFPEEEEGGCELRVKESRSADAPAYQQGQNQLYNELNLGRREEYDVLD KRRGRDPEMGGKPRRKNPQEGLYNELQKDKMAEAYSEIGMKGERRRGKGHDGLYQGLSTATKDTY DALHMQALPPR |
| 631 | EVQLLESGGGLVQPGGSLRLSCAASGFTFESEAMSWYRQAPGKERELVSVITSEGSTYYADSVKG RFTISRDNSKNTLYLQMNSLRAEDTAVYYCAHIEWETRLNWGQGTQVTVSSIEVMYPPPYLDNEK SNGTIIHVKGKHLCPSPLFPGPSKPFWVLVVVGGVLACYSLLVTVAFIIFWVRSKRSRLLHSDYM NMTPRRPGPTRKHYQPYAPPRDFAAYRSRVKFSRSADAPAYQQGQNQLYNELNLGRREEYDVLDK RRGRDPEMGGKPRRKNPQEGLYNELQKDKMAEAYSEIGMKGERRRGKGHDGLYQGLSTATKDTYD ALHMQALPPR |
| 632 | EVQLLESGGGLVQPGGSLRLSCAASGFTFESEAMSWYRQAPGKERELVSVITSEGSTYYADSVKG RFTISRDNSKNTLYLQMNSLRAEDTAVYYCAHIEWETRLNWGQGTQVTVSSIEVMYPPPYLDNEK SNGTIIHVKGKHLCPSPLFPGPSKPFWVLVVVGGVLACYSLLVTVAFIIFWVTKKKYSSSVHDPN GEYMFMRAVNTAKKSRLTDVTLRVKFSRSADAPAYQQGQNQLYNELNLGRREEYDVLDKRRGRDP EMGGKPRRKNPQEGLYNELQKDKMAEAYSEIGMKGERRRGKGHDGLYQGLSTATKDTYDALHMQA LPPR |
| 633 | EVQLLESGGGLVQPGGSLRLSCAASGFTFESEAMSWYRQAPGKERELVSVITSEGSTYYADSVKG RFTISRDNSKNTLYLQMNSLRAEDTAVYYCAHIEWETRLNWGQGTQVTVSSESKYGPPCPPCPIY IWAPLAGTCGVLLLSLVITLYCKRGRKKLLYIFKQPFMRPVQTTQEEDGCSCRFPEEEEGGCELR VKFSRSADAPAYQQGQNQLYNELNLGRREEYDVLDKRRGRDPEMGGKPRRKNPQEGLYNELQKDK MAEAYSEIGMKGERRRGKGHDGLYQGLSTATKDTYDALHMQALPPR |
| 634 | EVQLLESGGGLVQPGGSLRLSCAASGFTFESEAMSWYRQAPGKERELVSVITSEGSTYYADSVKG RFTISRDNSKNTLYLQMNSLRAEDTAVYYCAHIEWETRLNWGQGTQVTVSSESKYGPPCPPCPIY IWAPLAGTCGVLLLSLVITLYCRSKRSRLLHSDYMNMTPRRPGPTRKHYQPYAPPRDFAAYRSRV KFSRSADAPAYQQGQNQLYNELNLGRREEYDVLDKRRGRDPEMGGKPRRKNPQEGLYNELQKDKM AEAYSEIGMKGERRRGKGHDGLYQGLSTATKDTYDALHMQALPPR |
| 635 | EVQLLESGGGLVQPGGSLRLSCAASGFTFESEAMSWYRQAPGKERELVSVITSEGSTYYADSVKG RFTISRDNSKNTLYLQMNSLRAEDTAVYYCAHIEWETRLNWGQGTQVTVSSESKYGPPCPPCPIY IWAPLAGTCGVLLLSLVITLYCTKKKYSSSVHDPNGEYMFMRAVNTAKKSRLTDVTLRVKFSRSA DAPAYQQGQNQLYNELNLGRREEYDVLDKRRGRDPEMGGKPRRKNPQEGLYNELQKDKMAEAYSE IGMKGERRRGKGHDGLYQGLSTATKDTYDALHMQALPPR |
| 636 | EVQLLESGGGLVQPGGSLRLSCAASGFTFESEAMSWYRQAPGKERELVSVITSEGSTYYADSVKG RFTISRDNSKNTLYLQMNSLRAEDTAVYYCAHIEWETRLNWGQGTQVTVSSESKYGPPCPPCPFW VLVVVGGVLACYSLLVTVAFIIFWVKRGRKKLLYIFKQPFMRPVQTTQEEDGCSCRFPEEEEGGC ELRVKFSRSADAPAYQQGQNQLYNELNLGRREEYDVLDKRRGRDPEMGGKPRRKNPQEGLYNELQ KDKMAEAYSEIGMKGERRRGKGHDGLYQGLSTATKDTYDALHMQALPPR |
| 637 | EVQLLESGGGLVQPGGSLRLSCAASGFTFESEAMSWYRQAPGKERELVSVITSEGSTYYADSVKG RFTISRDNSKNTLYLQMNSLRAEDTAVYYCAHIEWETRLNWGQGTQVTVSSESKYGPPCPPCPFW VLVVVGGVLACYSLLVTVAFIIFWVRSKRSRLLHSDYMNMTPRRPGPTRKHYQPYAPPRDFAAYR SRVKFSRSADAPAYQQGQNQLYNELNLGRREEYDVLDKRRGRDPEMGGKPRRKNPQEGLYNELQK DKMAEAYSEIGMKGERRRGKGHDGLYQGLSTATKDTYDALHMQALPPR |
| 638 | EVQLLESGGGLVQPGGSLRLSCAASGFTFESEAMSWYRQAPGKERELVSVITSEGSTYYADSVKG RFTISRDNSKNTLYLQMNSLRAEDTAVYYCAHIEWETRLNWGQGTQVTVSSESKYGPPCPPCPFW VLVVVGGVLACYSLLVTVAFIIFWVTKKKYSSSVHDPNGEYMEMRAVNTAKKSRLTDVTLRVKES RSADAPAYQQGQNQLYNELNLGRREEYDVLDKRRGRDPEMGGKPRRKNPQEGLYNELQKDKMAEA YSEIGMKGERRRGKGHDGLYQGLSTATKDTYDALHMQALPPR |

-continued

| SEQ ID NO. | AMINO ACID SEQUENCE |
|---|---|
| 639 | EVQLLESGGGLVQPGGSLRLSCAASGFTFESEAMSWYRQAPGKERELVSVITSEGSTYYADSVKG<br>RFTISRDNSKNTLYLQMNSLRAEDTAVYYCAHIEWETRLNWGQGTQVTVSSLEPKSCDKTHTCPP<br>CPIYIWAPLAGTCGVLLLSLVITLYCKRGRKKLLYIFKQPFMRPVQTTQEEDGCSCRFPEEEEGG<br>CELRVKFSRSADAPAYQQGQNQLYNELNLGRREEYDVLDKRRGRDPEMGGKPRRKNPQEGLYNEL<br>QKDKMAEAYSEIGMKGERRRGKGHDGLYQGLSTATKDTYDALHMQALPPR |
| 640 | EVQLLESGGGLVQPGGSLRLSCAASGFTFESEAMSWYRQAPGKERELVSVITSEGSTYYADSVKG<br>RFTISRDNSKNTLYLQMNSLRAEDTAVYYCAHIEWETRLNWGQGTQVTVSSLEPKSCDKTHTCPP<br>CPIYIWAPLAGTCGVLLLSLVITLYCRSKRSRLLHSDYMNMTPRRPGPTRKHYQPYAPPRDFAAY<br>RSRVKFSRSADAPAYQQGQNQLYNELNLGRREEYDVLDKRRGRDPEMGGKPRRKNPQEGLYNELQ<br>KDKMAEAYSEIGMKGERRRGKGHDGLYQGLSTATKDTYDALHMQALPPR |
| 641 | EVQLLESGGGLVQPGGSLRLSCAASGFTFESEAMSWYRQAPGKERELVSVITSEGSTYYADSVKG<br>RFTISRDNSKNTLYLQMNSLRAEDTAVYYCAHIEWETRLNWGQGTQVTVSSLEPKSCDKTHTCPP<br>CPIYIWAPLAGTCGVLLLSLVITLYCTKKKYSSSVHDPNGEYMFMRAVNTAKKSRLTDVTLRVKF<br>SRSADAPAYQQGQNQLYNELNLGRREEYDVLDKRRGRDPEMGGKPRRKNPQEGLYNELQKDKMAE<br>AYSEIGMKGERRRGKGHDGLYQGLSTATKDTYDALHMQALPPR |
| 642 | EVQLLESGGGLVQPGGSLRLSCAASGFTFESEAMSWYRQAPGKERELVSVITSEGSTYYADSVKG<br>RFTISRDNSKNTLYLQMNSLRAEDTAVYYCAHIEWETRLNWGQGTQVTVSSLEPKSCDKTHTCPP<br>CPFWVLVVVGGVLACYSLLVTVAFIIFWVKRGRKKLLYIFKQPFMRPVQTTQEEDGCSCRFPEEE<br>EGGCELRVKFSRSADAPAYQQGQNQLYNELNLGRREEYDVLDKRRGRDPEMGGKPRRKNPQEGLY<br>NELQKDKMAEAYSEIGMKGERRRGKGHDGLYQGLSTATKDTYDALHMQALPPR |
| 643 | EVQLLESGGGLVQPGGSLRLSCAASGFTFESEAMSWYRQAPGKERELVSVITSEGSTYYADSVKG<br>RFTISRDNSKNTLYLQMNSLRAEDTAVYYCAHIEWETRLNWGQGTQVTVSSLEPKSCDKTHTCPP<br>CPFWVLVVVGGVLACYSLLVTVAFIIFWVRSKRSRLLHSDYMNMTPRRPGPTRKHYQPYAPPRDE<br>AAYRSRVKFSRSADAPAYQQGQNQLYNELNLGRREEYDVLDKRRGRDPEMGGKPRRKNPQEGLYN<br>ELQKDKMAEAYSEIGMKGERRRGKGHDGLYQGLSTATKDTYDALHMQALPPR |
| 644 | EVQLLESGGGLVQPGGSLRLSCAASGFTFESEAMSWYRQAPGKERELVSVITSEGSTYYADSVKG<br>RFTISRDNSKNTLYLQMNSLRAEDTAVYYCAHIEWETRLNWGQGTQVTVSSLEPKSCDKTHTCPP<br>CPFWVLVVVGGVLACYSLLVTVAFIIFWVTKKKYSSSVHDPNGEYMEMRAVNTAKKSRLTDVTLR<br>VKFSRSADAPAYQQGQNQLYNELNLGRREEYDVLDKRRGRDPEMGGKPRRKNPQEGLYNELQKDK<br>MAEAYSEIGMKGERRRGKGHDGLYQGLSTATKDTYDALHMQALPPR |

In particular embodiments, a CAR comprises an antibody or antigen binding fragment thereof comprising an amino acid sequence set forth in SEQ ID NO: 109; a spacer domain comprising an amino acid sequence set forth in SEQ ID NO: 145, SEQ ID NO: 146, SEQ ID NO: 148, or SEQ ID NO: 150; a transmembrane domain comprising an amino acid sequence set forth in SEQ ID NO: 151 or SEQ ID NO: 153; a costimulatory domain comprising an amino acid sequence set forth in SEQ ID NO: 159, SEQ ID NO: 160, or SEQ ID NO: 162; and a primary signaling domain comprising an amino acid sequence set forth in SEQ ID NO: 158. In particular embodiments, a CAR comprises an amino acid sequence set forth in any one of SEQ ID NOs: 645, 646, 647, 648, 649, 650, 651, 652, 653, 654, 655, 656, 657, 658, 659, 660, 661, 662, 663, 664, 665, 666, 667, and 668.

| SEQ ID NO. | AMINO ACID SEQUENCE |
|---|---|
| 645 | EVQLLESGGGLVQPGGSLRLSCAASGFTFDEYTMHWFRQAPGKEREFVSAISGGGSETYYADSVK<br>GRFTISRDNSKNTLYLQMNSLRAEDTAVYYCAAGGEEAGVGYWGQGTQVTVSSTTTPAPRPPTPA<br>PTIASQPLSLRPEACRPAAGGAVHTRGLDFACDIYIWAPLAGTCGVLLLSLVITLYCKRGRKKLL<br>YIFKQPFMRPVQTTQEEDGCSCRFPEEEEGGCELRVKFSRSADAPAYQQGQNQLYNELNLGRREE<br>YDVLDKRRGRDPEMGGKPRRKNPQEGLYNELQKDKMAEAYSEIGMKGERRRGKGHDGLYQGLSTA<br>TKDTYDALHMQALPPR |
| 646 | EVQLLESGGGLVQPGGSLRLSCAASGFTFDEYTMHWFRQAPGKEREFVSAISGGGSETYYADSVK<br>GRFTISRDNSKNTLYLQMNSLRAEDTAVYYCAAGGEEAGVGYWGQGTQVTVSSTTTPAPRPPTPA<br>PTIASQPLSLRPEACRPAAGGAVHTRGLDFACDIYIWAPLAGTCGVLLLSLVITLYCRSKRSRLL<br>HSDYMNMTPRRPGPTRKHYQPYAPPRDFAAYRSRVKFSRSADAPAYQQGQNQLYNELNLGRREEY<br>DVLDKRRGRDPEMGGKPRRKNPQEGLYNELQKDKMAEAYSEIGMKGERRRGKGHDGLYQGLSTAT<br>KDTYDALHMQALPPR |
| 647 | EVQLLESGGGLVQPGGSLRLSCAASGFTFDEYTMHWFRQAPGKEREFVSAISGGGSETYYADSVK<br>GRFTISRDNSKNTLYLQMNSLRAEDTAVYYCAAGGEEAGVGYWGQGTQVTVSSTTTPAPRPPTPA<br>PTIASQPLSLRPEACRPAAGGAVHTRGLDFACDIYIWAPLAGTCGVLLLSLVITLYCTKKKYSSS<br>VHDPNGEYMEMRAVNTAKKSRLTDVTLRVKFSRSADAPAYQQGQNQLYNELNLGRREEYDVLDKR<br>RGRDPEMGGKPRRKNPQEGLYNELQKDKMAEAYSEIGMKGERRRGKGHDGLYQGLSTATKDTYDA<br>LHMQALPPR |
| 648 | EVQLLESGGGLVQPGGSLRLSCAASGFTFDEYTMHWFRQAPGKEREFVSAISGGGSETYYADSVK<br>GRFTISRDNSKNTLYLQMNSLRAEDTAVYYCAAGGEEAGVGYWGQGTQVTVSSTTTPAPRPPTPA |

-continued

| SEQ ID NO. | AMINO ACID SEQUENCE |
|---|---|
| | PTIASQPLSLRPEACRPAAGGAVHTRGLDFACDFWVLVVVGGVLACYSLLVTVAFIIFWVKRGRK KLLYIFKQPFMRPVQTTQEEDGCSCRFPEEEEGGCELRVKFSRSADAPAYQQGQNQLYNELNLGR REEYDVLDKRRGRDPEMGGKPRRKNPQEGLYNELQKDKMAEAYSEIGMKGERRRGKGHDGLYQGL STATKDTYDALHMQALPPR |
| 649 | EVQLLESGGGLVQPGGSLRLSCAASGFTFDEYTMHWFRQAPGKEREFVSAISGGGSETYYADSVK GRFTISRDNSKNTLYLQMNSLRAEDTAVYYCAAGGEEAGVGYWGQGTQVTVSSTTTPAPRPPTPA PTIASQPLSLRPEACRPAAGGAVHTRGLDFACDFWVLVVVGGVLACYSLLVTVAFIIFWVRSKRS RLLHSDYMNMTPRRPGPTRKHYQPYAPPRDFAAYRSRVKFSRSADAPAYQQGQNQLYNELNLGRR EEYDVLDKRRGRDPEMGGKPRRKNPQEGLYNELQKDKMAEAYSEIGMKGERRRGKGHDGLYQGLS TATKDTYDALHMQALPPR |
| 650 | EVQLLESGGGLVQPGGSLRLSCAASGFTFDEYTMHWFRQAPGKEREFVSAISGGGSETYYADSVK GRFTISRDNSKNTLYLQMNSLRAEDTAVYYCAAGGEEAGVGYWGQGTQVTVSSTTTPAPRPPTPA PTIASQPLSLRPEACRPAAGGAVHTRGLDFACDFWVLVVVGGVLACYSLLVTVAFIIFWVTKKKY SSSVHDPNGEYMFMRAVNTAKKSRLTDVTLRVKFSRSADAPAYQQGQNQLYNELNLGRREEYDVL DKRRGRDPEMGGKPRRKNPQEGLYNELQKDKMAEAYSEIGMKGERRRGKGHDGLYQGLSTATKDT YDALHMQALPPR |
| 651 | EVQLLESGGGLVQPGGSLRLSCAASGFTFDEYTMHWFRQAPGKEREFVSAISGGGSETYYADSVK GRFTISRDNSKNTLYLQMNSLRAEDTAVYYCAAGGEEAGVGYWGQGTQVTVSSIEVMYPPPYLDN EKSNGTIIHVKGKHLCPSPLFPGPSKPIYIWAPLAGTCGVLLLSLVITLYCKRGRKKLLYIFKQP FMRPVQTTQEEDGCSCRFPEEEEGGCELRVKFSRSADAPAYQQGQNQLYNELNLGRREEYDVLDK RRGRDPEMGGKPRRKNPQEGLYNELQKDKMAEAYSEIGMKGERRRGKGHDGLYQGLSTATKDTYD ALHMQALPPR |
| 652 | EVQLLESGGGLVQPGGSLRLSCAASGFTFDEYTMHWFRQAPGKEREFVSAISGGGSETYYADSVK GRFTISRDNSKNTLYLQMNSLRAEDTAVYYCAAGGEEAGVGYWGQGTQVTVSSIEVMYPPPYLDN EKSNGTIIHVKGKHLCPSPLFPGPSKPIYIWAPLAGTCGVLLLSLVITLYCRSKRSRLLHSDYMN MTPRRPGPTRKHYQPYAPPRDFAAYRSRVKFSRSADAPAYQQGQNQLYNELNLGRREEYDVLDKR RGRDPEMGGKPRRKNPQEGLYNELQKDKMAEAYSEIGMKGERRRGKGHDGLYQGLSTATKDTYDA LHMQALPPR |
| 653 | EVQLLESGGGLVQPGGSLRLSCAASGFTFDEYTMHWFRQAPGKEREFVSAISGGGSETYYADSVK GRFTISRDNSKNTLYLQMNSLRAEDTAVYYCAAGGEEAGVGYWGQGTQVTVSSIEVMYPPPYLDN EKSNGTIIHVKGKHLCPSPLFPGPSKPIYIWAPLAGTCGVLLLSLVITLYCTKKKYSSSVHDPNG EYMFMRAVNTAKKSRLTDVTLRVKFSRSADAPAYQQGQNQLYNELNLGRREEYDVLDKRRGRDPE MGGKPRRKNPQEGLYNELQKDKMAEAYSEIGMKGERRRGKGHDGLYQGLSTATKDTYDALHMQAL PPR |
| 654 | EVQLLESGGGLVQPGGSLRLSCAASGFTFDEYTMHWFRQAPGKEREFVSAISGGGSETYYADSVK GRFTISRDNSKNTLYLQMNSLRAEDTAVYYCAAGGEEAGVGYWGQGTQVTVSSIEVMYPPPYLDN EKSNGTIIHVKGKHLCPSPLFPGPSKPFWVLVVVGGVLACYSLLVTVAFIIFWVKRGRKKLLYIF KQPFMRPVQTTQEEDGCSCRFPEEEEGGCELRVKFSRSADAPAYQQGQNQLYNELNLGRREEYDV LDKRRGRDPEMGGKPRRKNPQEGLYNELQKDKMAEAYSEIGMKGERRRGKGHDGLYQGLSTATKD TYDALHMQALPPR |
| 655 | EVQLLESGGGLVQPGGSLRLSCAASGFTFDEYTMHWFRQAPGKEREFVSAISGGGSETYYADSVK GRFTISRDNSKNTLYLQMNSLRAEDTAVYYCAAGGEEAGVGYWGQGTQVTVSSIEVMYPPPYLDN EKSNGTIIHVKGKHLCPSPLFPGPSKPFWVLVVVGGVLACYSLLVTVAFIIFWVRSKRSRLLHSD YMNMTPRRPGPTRKHYQPYAPPRDFAAYRSRVKFSRSADAPAYQQGQNQLYNELNLGRREEYDVL DKRRGRDPEMGGKPRRKNPQEGLYNELQKDKMAEAYSEIGMKGERRRGKGHDGLYQGLSTATKDT YDALHMQALPPR |
| 656 | EVQLLESGGGLVQPGGSLRLSCAASGFTFDEYTMHWFRQAPGKEREFVSAISGGGSETYYADSVK GRFTISRDNSKNTLYLQMNSLRAEDTAVYYCAAGGEEAGVGYWGQGTQVTVSSIEVMYPPPYLDN EKSNGTIIHVKGKHLCPSPLFPGPSKPFWVLVVVGGVLACYSLLVTVAFIIFWVTKKKYSSSVHD PNGEYMFMRAVNTAKKSRLTDVTLRVKFSRSADAPAYQQGQNQLYNELNLGRREEYDVLDKRRGR DPEMGGKPRRKNPQEGLYNELQKDKMAEAYSEIGMKGERRRGKGHDGLYQGLSTATKDTYDALHM QALPPR |
| 657 | EVQLLESGGGLVQPGGSLRLSCAASGFTFDEYTMHWFRQAPGKEREFVSAISGGGSETYYADSVK GRFTISRDNSKNTLYLQMNSLRAEDTAVYYCAAGGEEAGVGYWGQGTQVTVSSESKYGPPCPPCP IYIWAPLAGTCGVLLLSLVITLYCKRGRKKLLYIFKQPFMRPVQTTQEEDGCSCRFPEEEEGGCE LRVKFSRSADAPAYQQGQNQLYNELNLGRREEYDVLDKRRGRDPEMGGKPRRKNPQEGLYNELQK DKMAEAYSEIGMKGERRRGKGHDGLYQGLSTATKDTYDALHMQALPPR |
| 658 | EVQLLESGGGLVQPGGSLRLSCAASGFTFDEYTMHWFRQAPGKEREFVSAISGGGSETYYADSVK GRFTISRDNSKNTLYLQMNSLRAEDTAVYYCAAGGEEAGVGYWGQGTQVTVSSESKYGPPCPPCP IYIWAPLAGTCGVLLLSLVITLYCRSKRSRLLHSDYMNMTPRRPGPTRKHYQPYAPPRDFAAYRS RVKFSRSADAPAYQQGQNQLYNELNLGRREEYDVLDKRRGRDPEMGGKPRRKNPQEGLYNELQKD KMAEAYSEIGMKGERRRGKGHDGLYQGLSTATKDTYDALHMQALPPR |
| 659 | EVQLLESGGGLVQPGGSLRLSCAASGFTFDEYTMHWFRQAPGKEREFVSAISGGGSETYYADSVK GRFTISRDNSKNTLYLQMNSLRAEDTAVYYCAAGGEEAGVGYWGQGTQVTVSSESKYGPPCPPCP IYIWAPLAGTCGVLLLSLVITLYCTKKKYSSSVHDPNGEYMFMRAVNTAKKSRLTDVTLRVKFSR |

-continued

| SEQ ID NO. | AMINO ACID SEQUENCE |
|---|---|
| | SADAPAYQQGQNQLYNELNLGRREEYDVLDKRRGRDPEMGGKPRRKNPQEGLYNELQKDKMAEAY<br>SEIGMKGERRRGKGHDGLYQGLSTATKDTYDALHMQALPPR |
| 660 | EVQLLESGGGLVQPGGSLRLSCAASGFTFDEYTMHWFRQAPGKEREFVSAISGGGSETYYADSVK<br>GRFTISRDNSKNTLYLQMNSLRAEDTAVYYCAAGGEEAGVGYWGQGTQVTVSSESKYGPPCPPCP<br>FWVLVVVGGVLACYSLLVTVAFIIFWVKRGRKKLLYIFKQPFMRPVQTTQEEDGCSCRFPEEEEG<br>GCELRVKFSRSADAPAYQQGQNQLYNELNLGRREEYDVLDKRRGRDPEMGGKPRRKNPQEGLYNE<br>LQKDKMAEAYSEIGMKGERRRGKGHDGLYQGLSTATKDTYDALHMQALPPR |
| 661 | EVQLLESGGGLVQPGGSLRLSCAASGFTFDEYTMHWFRQAPGKEREFVSAISGGGSETYYADSVK<br>GRFTISRDNSKNTLYLQMNSLRAEDTAVYYCAAGGEEAGVGYWGQGTQVTVSSESKYGPPCPPCP<br>FWVLVVVGGVLACYSLLVTVAFIIFWVRSKRSRLLHSDYMNMTPRRPGPTRKHYQPYAPPRDFAA<br>YRSRVKFSRSADAPAYQQGQNQLYNELNLGRREEYDVLDKRRGRDPEMGGKPRRKNPQEGLYNEL<br>QKDKMAEAYSEIGMKGERRRGKGHDGLYQGLSTATKDTYDALHMQALPPR |
| 662 | EVQLLESGGGLVQPGGSLRLSCAASGFTFDEYTMHWFRQAPGKEREFVSAISGGGSETYYADSVK<br>GRFTISRDNSKNTLYLQMNSLRAEDTAVYYCAAGGEEAGVGYWGQGTQVTVSSESKYGPPCPPCP<br>FWVLVVVGGVLACYSLLVTVAFIIFWVTKKKYSSSVHDPNGEYMFMRAVNTAKKSRLTDVTLRVK<br>FSRSADAPAYQQGQNQLYNELNLGRREEYDVLDKRRGRDPEMGGKPRRKNPQEGLYNELQKDKMA<br>EAYSEIGMKGERRRGKGHDGLYQGLSTATKDTYDALHMQALPPR |
| 663 | EVQLLESGGGLVQPGGSLRLSCAASGFTFDEYTMHWFRQAPGKEREFVSAISGGGSETYYADSVK<br>GRFTISRDNSKNTLYLQMNSLRAEDTAVYYCAAGGEEAGVGYWGQGTQVTVSSLEPKSCDKTHTC<br>PPCPIYIWAPLAGTCGVLLLSLVITLYCKRGRKKLLYIFKQPFMRPVQTTQEEDGCSCRFPEEEE<br>GGCELRVKFSRSADAPAYQQGQNQLYNELNLGRREEYDVLDKRRGRDPEMGGKPRRKNPQEGLYN<br>ELQKDKMAEAYSEIGMKGERRRGKGHDGLYQGLSTATKDTYDALHMQALPPR |
| 664 | EVQLLESGGGLVQPGGSLRLSCAASGFTFDEYTMHWFRQAPGKEREFVSAISGGGSETYYADSVK<br>GRFTISRDNSKNTLYLQMNSLRAEDTAVYYCAAGGEEAGVGYWGQGTQVTVSSLEPKSCDKTHTC<br>PPCPIYIWAPLAGTCGVLLLSLVITLYCRSKRSRLLHSDYMNMTPRRPGPTRKHYQPYAPPRDFA<br>AYRSRVKFSRSADAPAYQQGQNQLYNELNLGRREEYDVLDKRRGRDPEMGGKPRRKNPQEGLYNE<br>LQKDKMAEAYSEIGMKGERRRGKGHDGLYQGLSTATKDTYDALHMQALPPR |
| 665 | EVQLLESGGGLVQPGGSLRLSCAASGFTFDEYTMHWFRQAPGKEREFVSAISGGGSETYYADSVK<br>GRFTISRDNSKNTLYLQMNSLRAEDTAVYYCAAGGEEAGVGYWGQGTQVTVSSLEPKSCDKTHTC<br>PPCPIYIWAPLAGTCGVLLLSLVITLYCTKKKYSSSVHDPNGEYMFMRAVNTAKKSRLTDVTLRV<br>KFSRSADAPAYQQGQNQLYNELNLGRREEYDVLDKRRGRDPEMGGKPRRKNPQEGLYNELQKDKM<br>AEAYSEIGMKGERRRGKGHDGLYQGLSTATKDTYDALHMQALPPR |
| 666 | EVQLLESGGGLVQPGGSLRLSCAASGFTFDEYTMHWFRQAPGKEREFVSAISGGGSETYYADSVK<br>GRFTISRDNSKNTLYLQMNSLRAEDTAVYYCAAGGEEAGVGYWGQGTQVTVSSLEPKSCDKTHTC<br>PPCPFWVLVVVGGVLACYSLLVTVAFIIFWVKRGRKKLLYIFKQPFMRPVQTTQEEDGCSCRFPE<br>EEEGGCELRVKFSRSADAPAYQQGQNQLYNELNLGRREEYDVLDKRRGRDPEMGGKPRRKNPQEG<br>LYNELQKDKMAEAYSEIGMKGERRRGKGHDGLYQGLSTATKDTYDALHMQALPPR |
| 667 | EVQLLESGGGLVQPGGSLRLSCAASGFTFDEYTMHWFRQAPGKEREFVSAISGGGSETYYADSVK<br>GRFTISRDNSKNTLYLQMNSLRAEDTAVYYCAAGGEEAGVGYWGQGTQVTVSSLEPKSCDKTHTC<br>PPCPFWVLVVVGGVLACYSLLVTVAFIIFWVRSKRSRLLHSDYMNMTPRRPGPTRKHYQPYAPPR<br>DFAAYRSRVKFSRSADAPAYQQGQNQLYNELNLGRREEYDVLDKRRGRDPEMGGKPRRKNPQEGL<br>YNELQKDKMAEAYSEIGMKGERRRGKGHDGLYQGLSTATKDTYDALHMQALPPR |
| 668 | EVQLLESGGGLVQPGGSLRLSCAASGFTFDEYTMHWFRQAPGKEREFVSAISGGGSETYYADSVK<br>GRFTISRDNSKNTLYLQMNSLRAEDTAVYYCAAGGEEAGVGYWGQGTQVTVSSLEPKSCDKTHTC<br>PPCPFWVLVVVGGVLACYSLLVTVAFIIFWVTKKKYSSSVHDPNGEYMFMRAVNTAKKSRLTDVT<br>LRVKFSRSADAPAYQQGQNQLYNELNLGRREEYDVLDKRRGRDPEMGGKPRRKNPQEGLYNELQK<br>DKMAEAYSEIGMKGERRRGKGHDGLYQGLSTATKDTYDALHMQALPPR |

In particular embodiments, a CAR comprises an antibody or antigen binding fragment thereof comprising an amino acid sequence set forth in SEQ ID NO: 113; a spacer domain comprising an amino acid sequence set forth in SEQ ID NO: 145, SEQ ID NO: 146, SEQ ID NO: 148, or SEQ ID NO: 150; a transmembrane domain comprising an amino acid sequence set forth in SEQ ID NO: 151 or SEQ ID NO: 153; a costimulatory domain comprising an amino acid sequence set forth in SEQ ID NO: 159, SEQ ID NO: 160, or SEQ ID NO: 162; and a primary signaling domain comprising an amino acid sequence set forth in SEQ ID NO: 158. In particular embodiments, a CAR comprises an amino acid sequence set forth in any one of SEQ ID NOs: 669, 670, 671, 672, 673, 674, 675, 676, 677, 678, 679, 680, 681, 682, 683, 684, 685, 686, 687, 688, 689, 690, 691, and 692.

| SEQ ID NO. | AMINO ACID SEQUENCE |
|---|---|
| 669 | EVQLLESGGGLVQPGGSLRLSCAASGFTFEDYAMSWFRQAPGKEREGVSAISGKGGSTYYADSVK<br>GRFTISRDNSKNTLYLQMNSLRAEDTAVYYCAVLDEEAGAEGGYWGQGTQVTVSSTTTPAPRPPT<br>PAPTIASQPLSLRPEACRPAAGGAVHTRGLDFACDIYIWAPLAGTCGVLLLSLVITLYCKRGRKK |

-continued

| SEQ ID NO. | AMINO ACID SEQUENCE |
|---|---|
| | LLYIFKQPFMRPVQTTQEEDGCSCRFPEEEEGGCELRVKFSRSADAPAYQQGQNQLYNELNLGRR EEYDVLDKRRGRDPEMGGKPRRKNPQEGLYNELQKDKMAEAYSEIGMKGERRRGKGHDGLYQGLS TATKDTYDALHMQALPPR |
| 670 | EVQLLESGGGLVQPGGSLRLSCAASGFTFEDYAMSWFRQAPGKEREGVSAISGKGGSTYYADSVK GRFTISRDNSKNTLYLQMNSLRAEDTAVYYCAVLDEEAGAEGGYWGQGTQVTVSSTTTPAPRPPT PAPTIASQPLSLRPEACRPAAGGAVHTRGLDFACDIYIWAPLAGTCGVLLLSLVITLYCRSKRSR LLHSDYMNMTPRRPGPTRKHYQPYAPPRDFAAYRSRVKFSRSADAPAYQQGQNQLYNELNLGRRE EYDVLDKRRGRDPEMGGKPRRKNPQEGLYNELQKDKMAEAYSEIGMKGERRRGKGHDGLYQGLST ATKDTYDALHMQALPPR |
| 671 | EVQLLESGGGLVQPGGSLRLSCAASGFTFEDYAMSWFRQAPGKEREGVSAISGKGGSTYYADSVK GRFTISRDNSKNTLYLQMNSLRAEDTAVYYCAVLDEEAGAEGGYWGQGTQVTVSSTTTPAPRPPT PAPTIASQPLSLRPEACRPAAGGAVHTRGLDFACDIYIWAPLAGTCGVLLLSLVITLYCTKKKYS SSVHDPNGEYMFMRAVNTAKKSRLTDVTLRVKFSRSADAPAYQQGQNQLYNELNLGRREEYDVLD KRRGRDPEMGGKPRRKNPQEGLYNELQKDKMAEAYSEIGMKGERRRGKGHDGLYQGLSTATKDTY DALHMQALPPR |
| 672 | EVQLLESGGGLVQPGGSLRLSCAASGFTFEDYAMSWFRQAPGKEREGVSAISGKGGSTYYADSVK GRFTISRDNSKNTLYLQMNSLRAEDTAVYYCAVLDEEAGAEGGYWGQGTQVTVSSTTTPAPRPPT PAPTIASQPLSLRPEACRPAAGGAVHTRGLDFACDFWVLVVVGGVLACYSLLVTVAFIIFWVKRG RKKLLYIFKQPFMRPVQTTQEEDGCSCRFPEEEEGGCELRVKFSRSADAPAYQQGQNQLYNELNL GRREEYDVLDKRRGRDPEMGGKPRRKNPQEGLYNELQKDKMAEAYSEIGMKGERRRGKGHDGLYQ GLSTATKDTYDALHMQALPPR |
| 673 | EVQLLESGGGLVQPGGSLRLSCAASGFTFEDYAMSWFRQAPGKEREGVSAISGKGGSTYYADSVK GRFTISRDNSKNTLYLQMNSLRAEDTAVYYCAVLDEEAGAEGGYWGQGTQVTVSSTTTPAPRPPT PAPTIASQPLSLRPEACRPAAGGAVHTRGLDFACDFWVLVVVGGVLACYSLLVTVAFIIFWVRSK RSRLLHSDYMNMTPRRPGPTRKHYQPYAPPRDFAAYRSRVKFSRSADAPAYQQGQNQLYNELNLG RREEYDVLDKRRGRDPEMGGKPRRKNPQEGLYNELQKDKMAEAYSEIGMKGERRRGKGHDGLYQG LSTATKDTYDALHMQALPPR |
| 674 | EVQLLESGGGLVQPGGSLRLSCAASGFTFEDYAMSWFRQAPGKEREGVSAISGKGGSTYYADSVK GRFTISRDNSKNTLYLQMNSLRAEDTAVYYCAVLDEEAGAEGGYWGQGTQVTVSSTTTPAPRPPT PAPTIASQPLSLRPEACRPAAGGAVHTRGLDFACDFWVLVVVGGVLACYSLLVTVAFIIFWVTKK KYSSSVHDPNGEYMFMRAVNTAKKSRLTDVTLRVKFSRSADAPAYQQGQNQLYNELNLGRREEYD VLDKRRGRDPEMGGKPRRKNPQEGLYNELQKDKMAEAYSEIGMKGERRRGKGHDGLYQGLSTATK DTYDALHMQALPPR |
| 675 | EVQLLESGGGLVQPGGSLRLSCAASGFTFEDYAMSWFRQAPGKEREGVSAISGKGGSTYYADSVK GRFTISRDNSKNTLYLQMNSLRAEDTAVYYCAVLDEEAGAEGGYWGQGTQVTVSSIEVMYPPPYL DNEKSNGTIIHVKGKHLCPSPLFPGPSKPIYIWAPLAGTCGVLLLSLVITLYCKRGRKKLLYIFK QPFMRPVQTTQEEDGCSCRFPEEEEGGCELRVKFSRSADAPAYQQGQNQLYNELNLGRREEYDVL DKRRGRDPEMGGKPRRKNPQEGLYNELQKDKMAEAYSEIGMKGERRRGKGHDGLYQGLSTATKDT YDALHMQALPPR |
| 676 | EVQLLESGGGLVQPGGSLRLSCAASGFTFEDYAMSWFRQAPGKEREGVSAISGKGGSTYYADSVK GRFTISRDNSKNTLYLQMNSLRAEDTAVYYCAVLDEEAGAEGGYWGQGTQVTVSSIEVMYPPPYL DNEKSNGTIIHVKGKHLCPSPLFPGPSKPIYIWAPLAGTCGVLLLSLVITLYCRSKRSRLLHSDY MNMTPRRPGPTRKHYQPYAPPRDFAAYRSRVKFSRSADAPAYQQGQNQLYNELNLGRREEYDVLD KRRGRDPEMGGKPRRKNPQEGLYNELQKDKMAEAYSEIGMKGERRRGKGHDGLYQGLSTATKDTY DALHMQALPPR |
| 677 | EVQLLESGGGLVQPGGSLRLSCAASGFTFEDYAMSWFRQAPGKEREGVSAISGKGGSTYYADSVK GRFTISRDNSKNTLYLQMNSLRAEDTAVYYCAVLDEEAGAEGGYWGQGTQVTVSSIEVMYPPPYL DNEKSNGTIIHVKGKHLCPSPLFPGPSKPIYIWAPLAGTCGVLLLSLVITLYCTKKKYSSSVHDP NGEYMFMRAVNTAKKSRLTDVTLRVKFSRSADAPAYQQGQNQLYNELNLGRREEYDVLDKRRGRD PEMGGKPRRKNPQEGLYNELQKDKMAEAYSEIGMKGERRRGKGHDGLYQGLSTATKDTYDALHMQ ALPPR |
| 678 | EVQLLESGGGLVQPGGSLRLSCAASGFTFEDYAMSWFRQAPGKEREGVSAISGKGGSTYYADSVK GRFTISRDNSKNTLYLQMNSLRAEDTAVYYCAVLDEEAGAEGGYWGQGTQVTVSSIEVMYPPPYL DNEKSNGTIIHVKGKHLCPSPLFPGPSKPFWVLVVVGGVLACYSLLVTVAFIIFWVKRGRKKLLY IFKQPFMRPVQTTQEEDGCSCRFPEEEEGGCELRVKFSRSADAPAYQQGQNQLYNELNLGRREEY DVLDKRRGRDPEMGGKPRRKNPQEGLYNELQKDKMAEAYSEIGMKGERRRGKGHDGLYQGLSTAT KDTYDALHMQALPPR |
| 679 | EVQLLESGGGLVQPGGSLRLSCAASGFTFEDYAMSWFRQAPGKEREGVSAISGKGGSTYYADSVK GRFTISRDNSKNTLYLQMNSLRAEDTAVYYCAVLDEEAGAEGGYWGQGTQVTVSSIEVMYPPPYL DNEKSNGTIIHVKGKHLCPSPLFPGPSKPFWVLVVVGGVLACYSLLVTVAFIIFWVRSKRSRLLH SDYMNMTPRRPGPTRKHYQPYAPPRDFAAYRSRVKFSRSADAPAYQQGQNQLYNELNLGRREEYD VLDKRRGRDPEMGGKPRRKNPQEGLYNELQKDKMAEAYSEIGMKGERRRGKGHDGLYQGLSTATK DTYDALHMQALPPR |
| 680 | EVQLLESGGGLVQPGGSLRLSCAASGFTFEDYAMSWFRQAPGKEREGVSAISGKGGSTYYADSVK GRFTISRDNSKNTLYLQMNSLRAEDTAVYYCAVLDEEAGAEGGYWGQGTQVTVSSIEVMYPPPYL |

-continued

| SEQ ID NO. | AMINO ACID SEQUENCE |
|---|---|
| | DNEKSNGTIIHVKGKHLCPSPLFPGPSKPFWVLVVVGGVLACYSLLVTVAFIIFWVTKKKYSSSV HDPNGEYMFMRAVNTAKKSRLTDVTLRVKFSRSADAPAYQQGQNQLYNELNLGRREEYDVLDKRR GRDPEMGGKPRRKNPQEGLYNELQKDKMAEAYSEIGMKGERRRGKGHDGLYQGLSTATKDTYDAL HMQALPPR |
| 681 | EVQLLESGGGLVQPGGSLRLSCAASGFTFEDYAMSWFRQAPGKEREGVSAISGKGGSTYYADSVK GRFTISRDNSKNTLYLQMNSLRAEDTAVYYCAVLDEEAGAEGGYWGQGTQVTVSSESKYGPPCPP CPIYIWAPLAGTCGVLLLSLVITLYCKRGRKKLLYIFKQPFMRPVQTTQEEDGCSCRFPEEEEGG CELRVKFSRSADAPAYQQGQNQLYNELNLGRREEYDVLDKRRGRDPEMGGKPRRKNPQEGLYNEL QKDKMAEAYSEIGMKGERRRGKGHDGLYQGLSTATKDTYDALHMQALPPR |
| 682 | EVQLLESGGGLVQPGGSLRLSCAASGFTFEDYAMSWFRQAPGKEREGVSAISGKGGSTYYADSVK GRFTISRDNSKNTLYLQMNSLRAEDTAVYYCAVLDEEAGAEGGYWGQGTQVTVSSESKYGPPCPP CPIYIWAPLAGTCGVLLLSLVITLYCRSKRSRLLHSDYMNMTPRRPGPTRKHYQPYAPPRDFAAY RSRVKFSRSADAPAYQQGQNQLYNELNLGRREEYDVLDKRRGRDPEMGGKPRRKNPQEGLYNELQ KDKMAEAYSEIGMKGERRRGKGHDGLYQGLSTATKDTYDALHMQALPPR |
| 683 | EVQLLESGGGLVQPGGSLRLSCAASGFTFEDYAMSWFRQAPGKEREGVSAISGKGGSTYYADSVK GRFTISRDNSKNTLYLQMNSLRAEDTAVYYCAVLDEEAGAEGGYWGQGTQVTVSSESKYGPPCPP CPIYIWAPLAGTCGVLLLSLVITLYCTKKKYSSSVHDPNGEYMFMRAVNTAKKSRLTDVTLRVKF SRSADAPAYQQGQNQLYNELNLGRREEYDVLDKRRGRDPEMGGKPRRKNPQEGLYNELQKDKMAE AYSEIGMKGERRRGKGHDGLYQGLSTATKDTYDALHMQALPPR |
| 684 | EVQLLESGGGLVQPGGSLRLSCAASGFTFEDYAMSWFRQAPGKEREGVSAISGKGGSTYYADSVK GRFTISRDNSKNTLYLQMNSLRAEDTAVYYCAVLDEEAGAEGGYWGQGTQVTVSSESKYGPPCPP CPFWVLVVVGGVLACYSLLVTVAFIIFWVKRGRKKLLYIFKQPFMRPVQTTQEEDGCSCRFPEEE EGGCELRVKFSRSADAPAYQQGQNQLYNELNLGRREEYDVLDKRRGRDPEMGGKPRRKNPQEGLY NELQKDKMAEAYSEIGMKGERRRGKGHDGLYQGLSTATKDTYDALHMQALPPR |
| 685 | EVQLLESGGGLVQPGGSLRLSCAASGFTFEDYAMSWFRQAPGKEREGVSAISGKGGSTYYADSVK GRFTISRDNSKNTLYLQMNSLRAEDTAVYYCAVLDEEAGAEGGYWGQGTQVTVSSESKYGPPCPP CPFWVLVVVGGVLACYSLLVTVAFIIFWVRSKRSRLLHSDYMNMTPRRPGPTRKHYQPYAPPRDE AAYRSRVKFSRSADAPAYQQGQNQLYNELNLGRREEYDVLDKRRGRDPEMGGKPRRKNPQEGLYN ELQKDKMAEAYSEIGMKGERRRGKGHDGLYQGLSTATKDTYDALHMQALPPR |
| 686 | EVQLLESGGGLVQPGGSLRLSCAASGFTFEDYAMSWFRQAPGKEREGVSAISGKGGSTYYADSVK GRFTISRDNSKNTLYLQMNSLRAEDTAVYYCAVLDEEAGAEGGYWGQGTQVTVSSESKYGPPCPP CPFWVLVVVGGVLACYSLLVTVAFIIFWVTKKKYSSSVHDPNGEYMEMRAVNTAKKSRLTDVTLR VKFSRSADAPAYQQGQNQLYNELNLGRREEYDVLDKRRGRDPEMGGKPRRKNPQEGLYNELQKDK MAEAYSEIGMKGERRRGKGHDGLYQGLSTATKDTYDALHMQALPPR |
| 687 | EVQLLESGGGLVQPGGSLRLSCAASGFTFEDYAMSWFRQAPGKEREGVSAISGKGGSTYYADSVK GRFTISRDNSKNTLYLQMNSLRAEDTAVYYCAVLDEEAGAEGGYWGQGTQVTVSSLEPKSCDKTH TCPPCPIYIWAPLAGTCGVLLLSLVITLYCKRGRKKLLYIFKQPEMRPVQTTQEEDGCSCRFPEE EEGGCELRVKFSRSADAPAYQQGQNQLYNELNLGRREEYDVLDKRRGRDPEMGGKPRRKNPQEGL YNELQKDKMAEAYSEIGMKGERRRGKGHDGLYQGLSTATKDTYDALHMQALPPR |
| 688 | EVQLLESGGGLVQPGGSLRLSCAASGFTFEDYAMSWFRQAPGKEREGVSAISGKGGSTYYADSVK GRFTISRDNSKNTLYLQMNSLRAEDTAVYYCAVLDEEAGAEGGYWGQGTQVTVSSLEPKSCDKTH TCPPCPIYIWAPLAGTCGVLLLSLVITLYCRSKRSRLLHSDYMNMTPRRPGPTRKHYQPYAPPRD FAAYRSRVKFSRSADAPAYQQGQNQLYNELNLGRREEYDVLDKRRGRDPEMGGKPRRKNPQEGLY NELQKDKMAEAYSEIGMKGERRRGKGHDGLYQGLSTATKDTYDALHMQALPPR |
| 689 | EVQLLESGGGLVQPGGSLRLSCAASGFTFEDYAMSWFRQAPGKEREGVSAISGKGGSTYYADSVK GRFTISRDNSKNTLYLQMNSLRAEDTAVYYCAVLDEEAGAEGGYWGQGTQVTVSSLEPKSCDKTH TCPPCPIYIWAPLAGTCGVLLLSLVITLYCTKKKYSSSVHDPNGEYMFMRAVNTAKKSRLTDVTL RVKFSRSADAPAYQQGQNQLYNELNLGRREEYDVLDKRRGRDPEMGGKPRRKNPQEGLYNELQKD KMAEAYSEIGMKGERRRGKGHDGLYQGLSTATKDTYDALHMQALPPR |
| 690 | EVQLLESGGGLVQPGGSLRLSCAASGFTFEDYAMSWFRQAPGKEREGVSAISGKGGSTYYADSVK GRFTISRDNSKNTLYLQMNSLRAEDTAVYYCAVLDEEAGAEGGYWGQGTQVTVSSLEPKSCDKTH TCPPCPFWVLVVVGGVLACYSLLVTVAFIIFWVKRGRKKLLYIFKQPFMRPVQTTQEEDGCSCRF PEEEEGGCELRVKFSRSADAPAYQQGQNQLYNELNLGRREEYDVLDKRRGRDPEMGGKPRRKNPQ EGLYNELQKDKMAEAYSEIGMKGERRRGKGHDGLYQGLSTATKDTYDALHMQALPPR |
| 691 | EVQLLESGGGLVQPGGSLRLSCAASGFTFEDYAMSWFRQAPGKEREGVSAISGKGGSTYYADSVK GRFTISRDNSKNTLYLQMNSLRAEDTAVYYCAVLDEEAGAEGGYWGQGTQVTVSSLEPKSCDKTH TCPPCPFWVLVVVGGVLACYSLLVTVAFIIFWVRSKRSRLLHSDYMNMTPRRPGPTRKHYQPYAP PRDFAAYRSRVKFSRSADAPAYQQGQNQLYNELNLGRREEYDVLDKRRGRDPEMGGKPRRKNPQE GLYNELQKDKMAEAYSEIGMKGERRRGKGHDGLYQGLSTATKDTYDALHMQALPPR |

-continued

| SEQ ID NO. | AMINO ACID SEQUENCE |
|---|---|
| 692 | EVQLLESGGGLVQPGGSLRLSCAASGFTFEDYAMSWFRQAPGKEREGVSAISGKGGSTYYADSVK GRFTISRDNSKNTLYLQMNSLRAEDTAVYYCAVLDEEAGAEGGYWGQGTQVTVSSLEPKSCDKTH TCPPCPFWVLVVVGGVLACYSLLVTVAFIIFWVTKKKYSSSVHDPNGEYMEMRAVNTAKKSRLTD VTLRVKFSRSADAPAYQQGQNQLYNELNLGRREEYDVLDKRRGRDPEMGGKPRRKNPQEGLYNEL QKDKMAEAYSEIGMKGERRRGKGHDGLYQGLSTATKDTYDALHMQALPPR |

In preferred embodiments, a CAR comprises an antibody or antigen binding fragment thereof comprising an amino acid sequence set forth in SEQ ID NO: 117; a spacer domain comprising an amino acid sequence set forth in SEQ ID NO: 145, SEQ ID NO: 146, SEQ ID NO: 148, or SEQ ID NO: 150; a transmembrane domain comprising an amino acid sequence set forth in SEQ ID NO: 151 or SEQ ID NO: 153; a costimulatory domain comprising an amino acid sequence set forth in SEQ ID NO: 159, SEQ ID NO: 160, or SEQ ID NO: 162; and a primary signaling domain comprising an amino acid sequence set forth in SEQ ID NO: 158. In preferred embodiments, a CAR comprises an amino acid sequence set forth in any one of SEQ ID NOs: 693, 694, 695, 696, 697, 698, 699, 700, 701, 702, 703, 704, 705, 706, 707, 708, 709, 710, 711, 712, 713, 714, 715, and 716.

| SEQ ID NO. | AMINO ACID SEQUENCE |
|---|---|
| 693 | EVQLLESGGGLVQPGGSLRLSCAASGFTFDRYAMSWFRQAPGKEREGVSAISTSGDSTYYADSVK GRFTISRDNSKNTLYLQMNSLRAEDTAVYYCAVLDEEAGAEGGYWGQGTQVTVSSTTTPAPRPPT PAPTIASQPLSLRPEACRPAAGGAVHTRGLDFACDIYIWAPLAGTCGVLLLSLVITLYCKRGRKK LLYIFKQPFMRPVQTTQEEDGCSCRFPEEEEGGCELRVKFSRSADAPAYQQGQNQLYNELNLGRR EEYDVLDKRRGRDPEMGGKPRRKNPQEGLYNELQKDKMAEAYSEIGMKGERRRGKGHDGLYQGLS TATKDTYDALHMQALPPR |
| 694 | EVQLLESGGGLVQPGGSLRLSCAASGFTFDRYAMSWFRQAPGKEREGVSAISTSGDSTYYADSVK GRFTISRDNSKNTLYLQMNSLRAEDTAVYYCAVLDEEAGAEGGYWGQGTQVTVSSTTTPAPRPPT PAPTIASQPLSLRPEACRPAAGGAVHTRGLDFACDIYIWAPLAGTCGVLLLSLVITLYCRSKRSR LLHSDYMNMTPRRPGPTRKHYQPYAPPRDFAAYRSRVKFSRSADAPAYQQGQNQLYNELNLGRRE EYDVLDKRRGRDPEMGGKPRRKNPQEGLYNELQKDKMAEAYSEIGMKGERRRGKGHDGLYQGLST ATKDTYDALHMQALPPR |
| 695 | EVQLLESGGGLVQPGGSLRLSCAASGFTFDRYAMSWFRQAPGKEREGVSAISTSGDSTYYADSVK GRFTISRDNSKNTLYLQMNSLRAEDTAVYYCAVLDEEAGAEGGYWGQGTQVTVSSTTTPAPRPPT PAPTIASQPLSLRPEACRPAAGGAVHTRGLDFACDIYIWAPLAGTCGVLLLSLVITLYCTKKKYS SSVHDPNGEYMFMRAVNTAKKSRLTDVTLRVKFSRSADAPAYQQGQNQLYNELNLGRREEYDVLD KRRGRDPEMGGKPRRKNPQEGLYNELQKDKMAEAYSEIGMKGERRRGKGHDGLYQGLSTATKDTY DALHMQALPPR |
| 696 | EVQLLESGGGLVQPGGSLRLSCAASGFTFDRYAMSWFRQAPGKEREGVSAISTSGDSTYYADSVK GRFTISRDNSKNTLYLQMNSLRAEDTAVYYCAVLDEEAGAEGGYWGQGTQVTVSSTTTPAPRPPT PAPTIASQPLSLRPEACRPAAGGAVHTRGLDFACDFWVLVVVGGVLACYSLLVTVAFIIFWVKRG RKKLLYIFKQPFMRPVQTTQEEDGCSCRFPEEEEGGCELRVKFSRSADAPAYQQGQNQLYNELNL GRREEYDVLDKRRGRDPEMGGKPRRKNPQEGLYNELQKDKMAEAYSEIGMKGERRRGKGHDGLYQ GLSTATKDTYDALHMQALPPR |
| 697 | EVQLLESGGGLVQPGGSLRLSCAASGFTFDRYAMSWFRQAPGKEREGVSAISTSGDSTYYADSVK GRFTISRDNSKNTLYLQMNSLRAEDTAVYYCAVLDEEAGAEGGYWGQGTQVTVSSTTTPAPRPPT PAPTIASQPLSLRPEACRPAAGGAVHTRGLDFACDFWVLVVVGGVLACYSLLVTVAFIIFWVRSK RSRLLHSDYMNMTPRRPGPTRKHYQPYAPPRDFAAYRSRVKFSRSADAPAYQQGQNQLYNELNLG RREEYDVLDKRRGRDPEMGGKPRRKNPQEGLYNELQKDKMAEAYSEIGMKGERRRGKGHDGLYQG LSTATKDTYDALHMQALPPR |
| 698 | EVQLLESGGGLVQPGGSLRLSCAASGFTFDRYAMSWFRQAPGKEREGVSAISTSGDSTYYADSVK GRFTISRDNSKNTLYLQMNSLRAEDTAVYYCAVLDEEAGAEGGYWGQGTQVTVSSTTTPAPRPPT PAPTIASQPLSLRPEACRPAAGGAVHTRGLDFACDFWVLVVVGGVLACYSLLVTVAFIIFWVTKK KYSSSVHDPNGEYMFMRAVNTAKKSRLTDVTLRVKFSRSADAPAYQQGQNQLYNELNLGRREEYD VLDKRRGRDPEMGGKPRRKNPQEGLYNELQKDKMAEAYSEIGMKGERRRGKGHDGLYQGLSTATK DTYDALHMQALPPR |
| 699 | EVQLLESGGGLVQPGGSLRLSCAASGFTFDRYAMSWFRQAPGKEREGVSAISTSGDSTYYADSVK GRFTISRDNSKNTLYLQMNSLRAEDTAVYYCAVLDEEAGAEGGYWGQGTQVTVSSIEVMYPPPYL DNEKSNGTIIHVKGKHLCPSPLFPGPSKPIYIWAPLAGTCGVLLLSLVITLYCKRGRKKLLYIFK QPFMRPVQTTQEEDGCSCRFPEEEEGGCELRVKFSRSADAPAYQQGQNQLYNELNLGRREEYDVL DKRRGRDPEMGGKPRRKNPQEGLYNELQKDKMAEAYSEIGMKGERRRGKGHDGLYQGLSTATKDT YDALHMQALPPR |
| 700 | EVQLLESGGGLVQPGGSLRLSCAASGFTFDRYAMSWFRQAPGKEREGVSAISTSGDSTYYADSVK GRFTISRDNSKNTLYLQMNSLRAEDTAVYYCAVLDEEAGAEGGYWGQGTQVTVSSIEVMYPPPYL DNEKSNGTIIHVKGKHLCPSPLFPGPSKPIYIWAPLAGTCGVLLLSLVITLYCRSKRSRLLHSDY |

-continued

| SEQ ID NO. | AMINO ACID SEQUENCE |
|---|---|
| | MNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 701 | EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 702 | EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 703 | EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 704 | EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 705 | EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSESKYGPPCPPCPIYIWAPLAGTCGVLLLSLVITLYCKRGRKKLLYIFKQPEMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 706 | EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 707 | EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 708 | EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSESKYGPPCPPCPFWVLVVVGGVLACYSLLVTVAFIIFWVKRGRKKLLYIFKQPEMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 709 | EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSESKYGPPCPPCPFWVLVVVGGVLACYSLLVTVAFIIFWVRSKRSRLLHSDYMNMTPRRPGPTRKHYQPYAPPRDEAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 710 | EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSESKYGPPCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 711 | EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 712 | EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSLEPKSCDKTH |

-continued

| SEQ ID NO. | AMINO ACID SEQUENCE |
|---|---|
| | TCPPCPIYIWAPLAGTCGVLLLSLVITLYCRSKRSRLLHSDYMNMTPRRPGPTRKHYQPYAPPRD<br>FAAYRSRVKFSRSADAPAYQQGQNQLYNELNLGRREEYDVLDKRRGRDPEMGGKPRRKNPQEGLY<br>NELQKDKMAEAYSEIGMKGERRRGKGHDGLYQGLSTATKDTYDALHMQALPPR |
| 713 | EVQLLESGGGLVQPGGSLRLSCAASGFTFDRYAMSWFRQAPGKEREGVSAISTSGDSTYYADSVK<br>GRFTISRDNSKNTLYLQMNSLRAEDTAVYYCAVLDEEAGAEGGYWGQGTQVTVSSLEPKSCDKTH<br>TCPPCPIYIWAPLAGTCGVLLLSLVITLYCTKKKYSSSVHDPNGEYMFMRAVNTAKKSRLTDVTL<br>RVKFSRSADAPAYQQGQNQLYNELNLGRREEYDVLDKRRGRDPEMGGKPRRKNPQEGLYNELQKD<br>KMAEAYSEIGMKGERRRGKGHDGLYQGLSTATKDTYDALHMQALPPR |
| 714 | EVQLLESGGGLVQPGGSLRLSCAASGFTFDRYAMSWFRQAPGKEREGVSAISTSGDSTYYADSVK<br>GRFTISRDNSKNTLYLQMNSLRAEDTAVYYCAVLDEEAGAEGGYWGQGTQVTVSSLEPKSCDKTH<br>TCPPCPFWVLVVVGGVLACYSLLVTVAFIIFWVKRGRKKLLYIFKQPFMRPVQTTQEEDGCSCRF<br>PEEEEGGCELRVKFSRSADAPAYQQGQNQLYNELNLGRREEYDVLDKRRGRDPEMGGKPRRKNPQ<br>EGLYNELQKDKMAEAYSEIGMKGERRRGKGHDGLYQGLSTATKDTYDALHMQALPPR |
| 715 | EVQLLESGGGLVQPGGSLRLSCAASGFTFDRYAMSWFRQAPGKEREGVSAISTSGDSTYYADSVK<br>GRFTISRDNSKNTLYLQMNSLRAEDTAVYYCAVLDEEAGAEGGYWGQGTQVTVSSLEPKSCDKTH<br>TCPPCPFWVLVVVGGVLACYSLLVTVAFIIFWVRSKRSRLLHSDYMNMTPRRPGPTRKHYQPYAP<br>PRDFAAYRSRVKFSRSADAPAYQQGQNQLYNELNLGRREEYDVLDKRRGRDPEMGGKPRRKNPQE<br>GLYNELQKDKMAEAYSEIGMKGERRRGKGHDGLYQGLSTATKDTYDALHMQALPPR |
| 716 | EVQLLESGGGLVQPGGSLRLSCAASGFTFDRYAMSWFRQAPGKEREGVSAISTSGDSTYYADSVK<br>GRFTISRDNSKNTLYLQMNSLRAEDTAVYYCAVLDEEAGAEGGYWGQGTQVTVSSLEPKSCDKTH<br>TCPPCPFWVLVVVGGVLACYSLLVTVAFIIFWVTKKKYSSSVHDPNGEYMEMRAVNTAKKSRLTD<br>VTLRVKFSRSADAPAYQQGQNQLYNELNLGRREEYDVLDKRRGRDPEMGGKPRRKNPQEGLYNEL<br>QKDKMAEAYSEIGMKGERRRGKGHDGLYQGLSTATKDTYDALHMQALPPR |

In particular embodiments, a CAR comprises an antibody or antigen binding fragment thereof comprising an amino acid sequence set forth in SEQ ID NO: 121; a spacer domain comprising an amino acid sequence set forth in SEQ ID NO: 145, SEQ ID NO: 146, SEQ ID NO: 148, or SEQ ID NO: 150; a transmembrane domain comprising an amino acid sequence set forth in SEQ ID NO: 151 or SEQ ID NO: 153; a costimulatory domain comprising an amino acid sequence set forth in SEQ ID NO: 159, SEQ ID NO: 160, or SEQ ID NO: 162; and a primary signaling domain comprising an amino acid sequence set forth in SEQ ID NO: 158. In particular embodiments, a CAR comprises an amino acid sequence set forth in any one of SEQ ID NOs: 717, 718, 719, 720, 721, 722, 723, 724, 725, 726, 727, 728, 729, 730, 731, 732, 733, 734, 735, 736, 737, 738, 739, and 740.

| SEQ ID NO. | AMINO ACID SEQUENCE |
|---|---|
| 717 | EVQLLESGGGLVQPGGSLRLSCAASGFTFASDAMSWYRQAPGKERELVSAISGSGGSTYYADSVK<br>GRFTISRDNSKNTLYLQMNSLRAEDTAVYYCAAHDSGEAYLAFDYWGQGTQVTVSSTTTPAPRPP<br>TPAPTIASQPLSLRPEACRPAAGGAVHTRGLDFACDIYIWAPLAGTCGVLLLSLVITLYCKRGRK<br>KLLYIFKQPFMRPVQTTQEEDGCSCRFPEEEEGGCELRVKFSRSADAPAYQQGQNQLYNELNLGR<br>REEYDVLDKRRGRDPEMGGKPRRKNPQEGLYNELQKDKMAEAYSEIGMKGERRRGKGHDGLYQGL<br>STATKDTYDALHMQALPPR |
| 718 | EVQLLESGGGLVQPGGSLRLSCAASGFTFASDAMSWYRQAPGKERELVSAISGSGGSTYYADSVK<br>GRFTISRDNSKNTLYLQMNSLRAEDTAVYYCAAHDSGEAYLAFDYWGQGTQVTVSSTTTPAPRPP<br>TPAPTIASQPLSLRPEACRPAAGGAVHTRGLDFACDIYIWAPLAGTCGVLLLSLVITLYCRSKRS<br>RLLHSDYMNMTPRRPGPTRKHYQPYAPPRDFAAYRSRVKFSRSADAPAYQQGQNQLYNELNLGRR<br>EEYDVLDKRRGRDPEMGGKPRRKNPQEGLYNELQKDKMAEAYSEIGMKGERRRGKGHDGLYQGLS<br>TATKDTYDALHMQALPPR |
| 719 | EVQLLESGGGLVQPGGSLRLSCAASGFTFASDAMSWYRQAPGKERELVSAISGSGGSTYYADSVK<br>GRFTISRDNSKNTLYLQMNSLRAEDTAVYYCAAHDSGEAYLAFDYWGQGTQVTVSSTTTPAPRPP<br>TPAPTIASQPLSLRPEACRPAAGGAVHTRGLDFACDIYIWAPLAGTCGVLLLSLVITLYCTKKKY<br>SSSVHDPNGEYMFMRAVNTAKKSRLTDVTLRVKFSRSADAPAYQQGQNQLYNELNLGRREEYDVL<br>DKRRGRDPEMGGKPRRKNPQEGLYNELQKDKMAEAYSEIGMKGERRRGKGHDGLYQGLSTATKDT<br>YDALHMQALPPR |
| 720 | EVQLLESGGGLVQPGGSLRLSCAASGFTFASDAMSWYRQAPGKERELVSAISGSGGSTYYADSVK<br>GRFTISRDNSKNTLYLQMNSLRAEDTAVYYCAAHDSGEAYLAFDYWGQGTQVTVSSTTTPAPRPP<br>TPAPTIASQPLSLRPEACRPAAGGAVHTRGLDFACDFWVLVVVGGVLACYSLLVTVAFIIFWVKR<br>GRKKLLYIFKQPFMRPVQTTQEEDGCSCRFPEEEEGGCELRVKFSRSADAPAYQQGQNQLYNELN<br>LGRREEYDVLDKRRGRDPEMGGKPRRKNPQEGLYNELQKDKMAEAYSEIGMKGERRRGKGHDGLY<br>QGLSTATKDTYDALHMQALPPR |
| 721 | EVQLLESGGGLVQPGGSLRLSCAASGFTFASDAMSWYRQAPGKERELVSAISGSGGSTYYADSVK<br>GRFTISRDNSKNTLYLQMNSLRAEDTAVYYCAAHDSGEAYLAFDYWGQGTQVTVSSTTTPAPRPP<br>TPAPTIASQPLSLRPEACRPAAGGAVHTRGLDFACDFWVLVVVGGVLACYSLLVTVAFIIFWVRS |

-continued

| SEQ ID NO. | AMINO ACID SEQUENCE |
|---|---|
| | KRSRLLHSDYMNMTPRRPGPTRKHYQPYAPPRDFAAYRSRVKFSRSADAPAYQQGQNQLYNELNL GRREEYDVLDKRRGRDPEMGGKPRRKNPQEGLYNELQKDKMAEAYSEIGMKGERRRGKGHDGLYQ GLSTATKDTYDALHMQALPPR |
| 722 | EVQLLESGGGLVQPGGSLRLSCAASGFTFASDAMSWYRQAPGKERELVSAISGSGGSTYYADSVK GRFTISRDNSKNTLYLQMNSLRAEDTAVYYCAAHDSGEAYLAFDYWGQGTQVTVSSTTTPAPRPP TPAPTIASQPLSLRPEACRPAAGGAVHTRGLDFACDFWVLVVVGGVLACYSLLVTVAFIIFWVTK KKYSSSVHDPNGEYMFMRAVNTAKKSRLTDVTLRVKFSRSADAPAYQQGQNQLYNELNLGRREEY DVLDKRRGRDPEMGGKPRRKNPQEGLYNELQKDKMAEAYSEIGMKGERRRGKGHDGLYQGLSTAT KDTYDALHMQALPPR |
| 723 | EVQLLESGGGLVQPGGSLRLSCAASGFTFASDAMSWYRQAPGKERELVSAISGSGGSTYYADSVK GRFTISRDNSKNTLYLQMNSLRAEDTAVYYCAAHDSGEAYLAFDYWGQGTQVTVSSIEVMYPPPY LDNEKSNGTIIHVKGKHLCPSPLFPGPSKPIYIWAPLAGTCGVLLLSLVITLYCKRGRKKLLYIF KQPFMRPVQTTQEEDGCSCRFPEEEEGGCELRVKFSRSADAPAYQQGQNQLYNELNLGRREEYDV LDKRRGRDPEMGGKPRRKNPQEGLYNELQKDKMAEAYSEIGMKGERRRGKGHDGLYQGLSTATKD TYDALHMQALPPR |
| 724 | EVQLLESGGGLVQPGGSLRLSCAASGFTFASDAMSWYRQAPGKERELVSAISGSGGSTYYADSVK GRFTISRDNSKNTLYLQMNSLRAEDTAVYYCAAHDSGEAYLAFDYWGQGTQVTVSSIEVMYPPPY LDNEKSNGTIIHVKGKHLCPSPLFPGPSKPIYIWAPLAGTCGVLLLSLVITLYCRSKRSRLLHSD YMNMTPRRPGPTRKHYQPYAPPRDFAAYRSRVKFSRSADAPAYQQGQNQLYNELNLGRREEYDVL DKRRGRDPEMGGKPRRKNPQEGLYNELQKDKMAEAYSEIGMKGERRRGKGHDGLYQGLSTATKDT YDALHMQALPPR |
| 725 | EVQLLESGGGLVQPGGSLRLSCAASGFTFASDAMSWYRQAPGKERELVSAISGSGGSTYYADSVK GRFTISRDNSKNTLYLQMNSLRAEDTAVYYCAAHDSGEAYLAFDYWGQGTQVTVSSIEVMYPPPY LDNEKSNGTIIHVKGKHLCPSPLFPGPSKPIYIWAPLAGTCGVLLLSLVITLYCTKKKYSSSVHD PNGEYMFMRAVNTAKKSRLTDVTLRVKFSRSADAPAYQQGQNQLYNELNLGRREEYDVLDKRRGR DPEMGGKPRRKNPQEGLYNELQKDKMAEAYSEIGMKGERRRGKGHDGLYQGLSTATKDTYDALHM QALPPR |
| 726 | EVQLLESGGGLVQPGGSLRLSCAASGFTFASDAMSWYRQAPGKERELVSAISGSGGSTYYADSVK GRFTISRDNSKNTLYLQMNSLRAEDTAVYYCAAHDSGEAYLAFDYWGQGTQVTVSSIEVMYPPPY LDNEKSNGTIIHVKGKHLCPSPLFPGPSKPFWVLVVVGGVLACYSLLVTVAFIIFWVKRGRKKLL YIFKQPFMRPVQTTQEEDGCSCRFPEEEEGGCELRVKFSRSADAPAYQQGQNQLYNELNLGRREE YDVLDKRRGRDPEMGGKPRRKNPQEGLYNELQKDKMAEAYSEIGMKGERRRGKGHDGLYQGLSTA TKDTYDALHMQALPPR |
| 727 | EVQLLESGGGLVQPGGSLRLSCAASGFTFASDAMSWYRQAPGKERELVSAISGSGGSTYYADSVK GRFTISRDNSKNTLYLQMNSLRAEDTAVYYCAAHDSGEAYLAFDYWGQGTQVTVSSIEVMYPPPY LDNEKSNGTIIHVKGKHLCPSPLFPGPSKPFWVLVVVGGVLACYSLLVTVAFIIFWVRSKRSRLL HSDYMNMTPRRPGPTRKHYQPYAPPRDFAAYRSRVKFSRSADAPAYQQGQNQLYNELNLGRREEY DVLDKRRGRDPEMGGKPRRKNPQEGLYNELQKDKMAEAYSEIGMKGERRRGKGHDGLYQGLSTAT KDTYDALHMQALPPR |
| 728 | EVQLLESGGGLVQPGGSLRLSCAASGFTFASDAMSWYRQAPGKERELVSAISGSGGSTYYADSVK GRFTISRDNSKNTLYLQMNSLRAEDTAVYYCAAHDSGEAYLAFDYWGQGTQVTVSSIEVMYPPPY LDNEKSNGTIIHVKGKHLCPSPLFPGPSKPFWVLVVVGGVLACYSLLVTVAFIIFWVTKKKYSSS VHDPNGEYMFMRAVNTAKKSRLTDVTLRVKFSRSADAPAYQQGQNQLYNELNLGRREEYDVLDKR RGRDPEMGGKPRRKNPQEGLYNELQKDKMAEAYSEIGMKGERRRGKGHDGLYQGLSTATKDTYDA LHMQALPPR |
| 729 | EVQLLESGGGLVQPGGSLRLSCAASGFTFASDAMSWYRQAPGKERELVSAISGSGGSTYYADSVK GRFTISRDNSKNTLYLQMNSLRAEDTAVYYCAAHDSGEAYLAFDYWGQGTQVTVSSESKYGPPCP PCPIYIWAPLAGTCGVLLLSLVITLYCKRGRKKLLYIFKQPFMRPVQTTQEEDGCSCRFPEEEEG GCELRVKFSRSADAPAYQQGQNQLYNELNLGRREEYDVLDKRRGRDPEMGGKPRRKNPQEGLYNE LQKDKMAEAYSEIGMKGERRRGKGHDGLYQGLSTATKDTYDALHMQALPPR |
| 730 | EVQLLESGGGLVQPGGSLRLSCAASGFTFASDAMSWYRQAPGKERELVSAISGSGGSTYYADSVK GRFTISRDNSKNTLYLQMNSLRAEDTAVYYCAAHDSGEAYLAFDYWGQGTQVTVSSESKYGPPCP PCPIYIWAPLAGTCGVLLLSLVITLYCRSKRSRLLHSDYMNMTPRRPGPTRKHYQPYAPPRDFAA YRSRVKFSRSADAPAYQQGQNQLYNELNLGRREEYDVLDKRRGRDPEMGGKPRRKNPQEGLYNEL QKDKMAEAYSEIGMKGERRRGKGHDGLYQGLSTATKDTYDALHMQALPPR |
| 731 | EVQLLESGGGLVQPGGSLRLSCAASGFTFASDAMSWYRQAPGKERELVSAISGSGGSTYYADSVK GRFTISRDNSKNTLYLQMNSLRAEDTAVYYCAAHDSGEAYLAFDYWGQGTQVTVSSESKYGPPCP PCPIYIWAPLAGTCGVLLLSLVITLYCTKKKYSSSVHDPNGEYMFMRAVNTAKKSRLTDVTLRVK FSRSADAPAYQQGQNQLYNELNLGRREEYDVLDKRRGRDPEMGGKPRRKNPQEGLYNELQKDKMA EAYSEIGMKGERRRGKGHDGLYQGLSTATKDTYDALHMQALPPR |
| 732 | EVQLLESGGGLVQPGGSLRLSCAASGFTFASDAMSWYRQAPGKERELVSAISGSGGSTYYADSVK GRFTISRDNSKNTLYLQMNSLRAEDTAVYYCAAHDSGEAYLAFDYWGQGTQVTVSSESKYGPPCP |

-continued

| SEQ ID NO. | AMINO ACID SEQUENCE |
|---|---|
| | PCPFWVLVVVGGVLACYSLLVTVAFIIFWVKRGRKKLLYIFKQPFMRPVQTTQEEDGCSCRFPEE<br>EEGGCELRVKFSRSADAPAYQQGQNQLYNELNLGRREEYDVLDKRRGRDPEMGGKPRRKNPQEGL<br>YNELQKDKMAEAYSEIGMKGERRRGKGHDGLYQGLSTATKDTYDALHMQALPPR |
| 733 | EVQLLESGGGLVQPGGSLRLSCAASGFTFASDAMSWYRQAPGKERELVSAISGSGGSTYYADSVK<br>GRFTISRDNSKNTLYLQMNSLRAEDTAVYYCAAHDSGEAYLAFDYWGQGTQVTVSSESKYGPPCP<br>PCPFWVLVVVGGVLACYSLLVTVAFIIFWVRSKRSRLLHSDYMNMTPRRPGPTRKHYQPYAPPRD<br>FAAYRSRVKFSRSADAPAYQQGQNQLYNELNLGRREEYDVLDKRRGRDPEMGGKPRRKNPQEGLY<br>NELQKDKMAEAYSEIGMKGERRRGKGHDGLYQGLSTATKDTYDALHMQALPPR |
| 734 | EVQLLESGGGLVQPGGSLRLSCAASGFTFASDAMSWYRQAPGKERELVSAISGSGGSTYYADSVK<br>GRFTISRDNSKNTLYLQMNSLRAEDTAVYYCAAHDSGEAYLAFDYWGQGTQVTVSSESKYGPPCP<br>PCPFWVLVVVGGVLACYSLLVTVAFIIFWVTKKKYSSSVHDPNGEYMFMRAVNTAKKSRLTDVTL<br>RVKFSRSADAPAYQQGQNQLYNELNLGRREEYDVLDKRRGRDPEMGGKPRRKNPQEGLYNELQKD<br>KMAEAYSEIGMKGERRRGKGHDGLYQGLSTATKDTYDALHMQALPPR |
| 735 | EVQLLESGGGLVQPGGSLRLSCAASGFTFASDAMSWYRQAPGKERELVSAISGSGGSTYYADSVK<br>GRFTISRDNSKNTLYLQMNSLRAEDTAVYYCAAHDSGEAYLAFDYWGQGTQVTVSSLEPKSCDKT<br>HTCPPCPIYIWAPLAGTCGVLLLSLVITLYCKRGRKKLLYIFKQPFMRPVQTTQEEDGCSCRFPE<br>EEEGGCELRVKFSRSADAPAYQQGQNQLYNELNLGRREEYDVLDKRRGRDPEMGGKPRRKNPQEG<br>LYNELQKDKMAEAYSEIGMKGERRRGKGHDGLYQGLSTATKDTYDALHMQALPPR |
| 736 | EVQLLESGGGLVQPGGSLRLSCAASGFTFASDAMSWYRQAPGKERELVSAISGSGGSTYYADSVK<br>GRFTISRDNSKNTLYLQMNSLRAEDTAVYYCAAHDSGEAYLAFDYWGQGTQVTVSSLEPKSCDKT<br>HTCPPCPIYIWAPLAGTCGVLLLSLVITLYCRSKRSRLLHSDYMNMTPRRPGPTRKHYQPYAPPR<br>DFAAYRSRVKFSRSADAPAYQQGQNQLYNELNLGRREEYDVLDKRRGRDPEMGGKPRRKNPQEGL<br>YNELQKDKMAEAYSEIGMKGERRRGKGHDGLYQGLSTATKDTYDALHMQALPPR |
| 737 | EVQLLESGGGLVQPGGSLRLSCAASGFTFASDAMSWYRQAPGKERELVSAISGSGGSTYYADSVK<br>GRFTISRDNSKNTLYLQMNSLRAEDTAVYYCAAHDSGEAYLAFDYWGQGTQVTVSSLEPKSCDKT<br>HTCPPCPIYIWAPLAGTCGVLLLSLVITLYCTKKKYSSSVHDPNGEYMFMRAVNTAKKSRLTDVT<br>LRVKFSRSADAPAYQQGQNQLYNELNLGRREEYDVLDKRRGRDPEMGGKPRRKNPQEGLYNELQK<br>DKMAEAYSEIGMKGERRRGKGHDGLYQGLSTATKDTYDALHMQALPPR |
| 738 | EVQLLESGGGLVQPGGSLRLSCAASGFTFASDAMSWYRQAPGKERELVSAISGSGGSTYYADSVK<br>GRFTISRDNSKNTLYLQMNSLRAEDTAVYYCAAHDSGEAYLAFDYWGQGTQVTVSSLEPKSCDKT<br>HTCPPCPFWVLVVVGGVLACYSLLVTVAFIIFWVKRGRKKLLYIFKQPFMRPVQTTQEEDGCSCR<br>FPEEEEGGCELRVKFSRSADAPAYQQGQNQLYNELNLGRREEYDVLDKRRGRDPEMGGKPRRKNP<br>QEGLYNELQKDKMAEAYSEIGMKGERRRGKGHDGLYQGLSTATKDTYDALHMQALPPR |
| 739 | EVQLLESGGGLVQPGGSLRLSCAASGFTFASDAMSWYRQAPGKERELVSAISGSGGSTYYADSVK<br>GRFTISRDNSKNTLYLQMNSLRAEDTAVYYCAAHDSGEAYLAFDYWGQGTQVTVSSLEPKSCDKT<br>HTCPPCPFWVLVVVGGVLACYSLLVTVAFIIFWVRSKRSRLLHSDYMNMTPRRPGPTRKHYQPYA<br>PPRDFAAYRSRVKFSRSADAPAYQQGQNQLYNELNLGRREEYDVLDKRRGRDPEMGGKPRRKNPQ<br>EGLYNELQKDKMAEAYSEIGMKGERRRGKGHDGLYQGLSTATKDTYDALHMQALPPR |
| 740 | EVQLLESGGGLVQPGGSLRLSCAASGFTFASDAMSWYRQAPGKERELVSAISGSGGSTYYADSVK<br>GRFTISRDNSKNTLYLQMNSLRAEDTAVYYCAAHDSGEAYLAFDYWGQGTQVTVSSLEPKSCDKT<br>HTCPPCPFWVLVVVGGVLACYSLLVTVAFIIFWVTKKKYSSSVHDPNGEYMFMRAVNTAKKSRLT<br>DVTLRVKFSRSADAPAYQQGQNQLYNELNLGRREEYDVLDKRRGRDPEMGGKPRRKNPQEGLYNE<br>LQKDKMAEAYSEIGMKGERRRGKGHDGLYQGLSTATKDTYDALHMQALPPR |

In particular embodiments, a CAR comprises an antibody or antigen binding fragment thereof comprising an amino acid sequence set forth in SEQ ID NO: 125; a spacer domain comprising an amino acid sequence set forth in SEQ ID NO: 145, SEQ ID NO: 146, SEQ ID NO: 148, or SEQ ID NO: 150; a transmembrane domain comprising an amino acid sequence set forth in SEQ ID NO: 151 or SEQ ID NO: 153; a costimulatory domain comprising an amino acid sequence set forth in SEQ ID NO: 159, SEQ ID NO: 160, or SEQ ID NO: 162; and a primary signaling domain comprising an amino acid sequence set forth in SEQ ID NO: 158. In particular embodiments, a CAR comprises an amino acid sequence set forth in any one of SEQ ID NOs: 741, 742, 743, 744, 745, 746, 747, 748, 749, 750, 751, 752, 753, 754, 755, 756, 757, 758, 759, 760, 761, 762, 763, and 764.

| SEQ ID NO. | AMINO ACID SEQUENCE |
|---|---|
| 741 | EVQLLESGGGLVQPGGSLRLSCAASGFTFDSYTMSWYRQAPGKERELVSAISGHGDSTYYADSVK<br>GRFTISRDNSKNTLYLQMNSLRAEDTAVYYCTRISITTEWLAGDYWGQGTQVTVSSTTTPAPRPP<br>TPAPTIASQPLSLRPEACRPAAGGAVHTRGLDFACDIYIWAPLAGTCGVLLLSLVITLYCKRGRK<br>KLLYIFKQPFMRPVQTTQEEDGCSCRFPEEEEGGCELRVKFSRSADAPAYQQGQNQLYNELNLGR<br>REEYDVLDKRRGRDPEMGGKPRRKNPQEGLYNELQKDKMAEAYSEIGMKGERRRGKGHDGLYQGL<br>STATKDTYDALHMQALPPR |

-continued

| SEQ ID NO. | AMINO ACID SEQUENCE |
|---|---|
| 742 | EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 743 | EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 744 | EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 745 | EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 746 | EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 747 | EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 748 | EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 749 | EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 750 | EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 751 | EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 752 | EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKR |

-continued

| SEQ ID NO. | AMINO ACID SEQUENCE |
|---|---|
| | RGRDPEMGGKPRRKNPQEGLYNELQKDKMAEAYSEIGMKGERRRGKGHDGLYQGLSTATKDTYDA LHMQALPPR |
| 753 | EVQLLESGGGLVQPGGSLRLSCAASGFTFDSYTMSWYRQAPGKERELVSAISGHGDSTYYADSVK GRFTISRDNSKNTLYLQMNSLRAEDTAVYYCTRISITTEWLAGDYWGQGTQVTVSSESKYGPPCP PCPIYIWAPLAGTCGVLLLSLVITLYCKRGRKKLLYIFKQPFMRPVQTTQEEDGCSCRFPEEEEG GCELRVKFSRSADAPAYQQGQNQLYNELNLGRREEYDVLDKRRGRDPEMGGKPRRKNPQEGLYNE LQKDKMAEAYSEIGMKGERRRGKGHDGLYQGLSTATKDTYDALHMQALPPR |
| 754 | EVQLLESGGGLVQPGGSLRLSCAASGFTFDSYTMSWYRQAPGKERELVSAISGHGDSTYYADSVK GRFTISRDNSKNTLYLQMNSLRAEDTAVYYCTRISITTEWLAGDYWGQGTQVTVSSESKYGPPCP PCPIYIWAPLAGTCGVLLLSLVITLYCRSKRSRLLHSDYMNMTPRRPGPTRKHYQPYAPPRDFAA YRSRVKFSRSADAPAYQQGQNQLYNELNLGRREEYDVLDKRRGRDPEMGGKPRRKNPQEGLYNEL QKDKMAEAYSEIGMKGERRRGKGHDGLYQGLSTATKDTYDALHMQALPPR |
| 755 | EVQLLESGGGLVQPGGSLRLSCAASGFTFDSYTMSWYRQAPGKERELVSAISGHGDSTYYADSVK GRFTISRDNSKNTLYLQMNSLRAEDTAVYYCTRISITTEWLAGDYWGQGTQVTVSSESKYGPPCP PCPIYIWAPLAGTCGVLLLSLVITLYCTKKKYSSSVHDPNGEYMFMRAVNTAKKSRLTDVTLRVK FSRSADAPAYQQGQNQLYNELNLGRREEYDVLDKRRGRDPEMGGKPRRKNPQEGLYNELQKDKMA EAYSEIGMKGERRRGKGHDGLYQGLSTATKDTYDALHMQALPPR |
| 756 | EVQLLESGGGLVQPGGSLRLSCAASGFTFDSYTMSWYRQAPGKERELVSAISGHGDSTYYADSVK GRFTISRDNSKNTLYLQMNSLRAEDTAVYYCTRISITTEWLAGDYWGQGTQVTVSSESKYGPPCP PCPFWVLVVVGGVLACYSLLVTVAFIIFWVKRGRKKLLYIFKQPFMRPVQTTQEEDGCSCRFPEE EEGGCELRVKFSRSADAPAYQQGQNQLYNELNLGRREEYDVLDKRRGRDPEMGGKPRRKNPQEGL YNELQKDKMAEAYSEIGMKGERRRGKGHDGLYQGLSTATKDTYDALHMQALPPR |
| 757 | EVQLLESGGGLVQPGGSLRLSCAASGFTFDSYTMSWYRQAPGKERELVSAISGHGDSTYYADSVK GRFTISRDNSKNTLYLQMNSLRAEDTAVYYCTRISITTEWLAGDYWGQGTQVTVSSESKYGPPCP PCPFWVLVVVGGVLACYSLLVTVAFIIFWVRSKRSRLLHSDYMNMTPRRPGPTRKHYQPYAPPRD FAAYRSRVKFSRSADAPAYQQGQNQLYNELNLGRREEYDVLDKRRGRDPEMGGKPRRKNPQEGLY NELQKDKMAEAYSEIGMKGERRRGKGHDGLYQGLSTATKDTYDALHMQALPPR |
| 758 | EVQLLESGGGLVQPGGSLRLSCAASGFTFDSYTMSWYRQAPGKERELVSAISGHGDSTYYADSVK GRFTISRDNSKNTLYLQMNSLRAEDTAVYYCTRISITTEWLAGDYWGQGTQVTVSSESKYGPPCP PCPFWVLVVVGGVLACYSLLVTVAFIIFWVTKKKYSSSVHDPNGEYMFMRAVNTAKKSRLTDVTL RVKFSRSADAPAYQQGQNQLYNELNLGRREEYDVLDKRRGRDPEMGGKPRRKNPQEGLYNELQKD KMAEAYSEIGMKGERRRGKGHDGLYQGLSTATKDTYDALHMQALPPR |
| 759 | EVQLLESGGGLVQPGGSLRLSCAASGFTFDSYTMSWYRQAPGKERELVSAISGHGDSTYYADSVK GRFTISRDNSKNTLYLQMNSLRAEDTAVYYCTRISITTEWLAGDYWGQGTQVTVSSLEPKSCDKT HTCPPCPIYIWAPLAGTCGVLLLSLVITLYCKRGRKKLLYIFKQPFMRPVQTTQEEDGCSCRFPE EEEGGCELRVKFSRSADAPAYQQGQNQLYNELNLGRREEYDVLDKRRGRDPEMGGKPRRKNPQEG LYNELQKDKMAEAYSEIGMKGERRRGKGHDGLYQGLSTATKDTYDALHMQALPPR |
| 760 | EVQLLESGGGLVQPGGSLRLSCAASGFTFDSYTMSWYRQAPGKERELVSAISGHGDSTYYADSVK GRFTISRDNSKNTLYLQMNSLRAEDTAVYYCTRISITTEWLAGDYWGQGTQVTVSSLEPKSCDKT HTCPPCPIYIWAPLAGTCGVLLLSLVITLYCRSKRSRLLHSDYMNMTPRRPGPTRKHYQPYAPPR DFAAYRSRVKFSRSADAPAYQQGQNQLYNELNLGRREEYDVLDKRRGRDPEMGGKPRRKNPQEGL YNELQKDKMAEAYSEIGMKGERRRGKGHDGLYQGLSTATKDTYDALHMQALPPR |
| 761 | EVQLLESGGGLVQPGGSLRLSCAASGFTFDSYTMSWYRQAPGKERELVSAISGHGDSTYYADSVK GRFTISRDNSKNTLYLQMNSLRAEDTAVYYCTRISITTEWLAGDYWGQGTQVTVSSLEPKSCDKT HTCPPCPIYIWAPLAGTCGVLLLSLVITLYCTKKKYSSSVHDPNGEYMFMRAVNTAKKSRLTDVT LRVKFSRSADAPAYQQGQNQLYNELNLGRREEYDVLDKRRGRDPEMGGKPRRKNPQEGLYNELQK DKMAEAYSEIGMKGERRRGKGHDGLYQGLSTATKDTYDALHMQALPPR |
| 762 | EVQLLESGGGLVQPGGSLRLSCAASGFTFDSYTMSWYRQAPGKERELVSAISGHGDSTYYADSVK GRFTISRDNSKNTLYLQMNSLRAEDTAVYYCTRISITTEWLAGDYWGQGTQVTVSSLEPKSCDKT HTCPPCPFWVLVVVGGVLACYSLLVTVAFIIFWVKRGRKKLLYIFKQPFMRPVQTTQEEDGCSCR FPEEEEGGCELRVKFSRSADAPAYQQGQNQLYNELNLGRREEYDVLDKRRGRDPEMGGKPRRKNP QEGLYNELQKDKMAEAYSEIGMKGERRRGKGHDGLYQGLSTATKDTYDALHMQALPPR |
| 763 | EVQLLESGGGLVQPGGSLRLSCAASGFTFDSYTMSWYRQAPGKERELVSAISGHGDSTYYADSVK GRFTISRDNSKNTLYLQMNSLRAEDTAVYYCTRISITTEWLAGDYWGQGTQVTVSSLEPKSCDKT HTCPPCPFWVLVVVGGVLACYSLLVTVAFIIFWVRSKRSRLLHSDYMNMTPRRPGPTRKHYQPYA PPRDFAAYRSRVKFSRSADAPAYQQGQNQLYNELNLGRREEYDVLDKRRGRDPEMGGKPRRKNPQ EGLYNELQKDKMAEAYSEIGMKGERRRGKGHDGLYQGLSTATKDTYDALHMQALPPR |
| 764 | EVQLLESGGGLVQPGGSLRLSCAASGFTFDSYTMSWYRQAPGKERELVSAISGHGDSTYYADSVK GRFTISRDNSKNTLYLQMNSLRAEDTAVYYCTRISITTEWLAGDYWGQGTQVTVSSLEPKSCDKT HTCPPCPFWVLVVVGGVLACYSLLVTVAFIIFWVTKKKYSSSVHDPNGEYMFMRAVNTAKKSRLT DVTLRVKFSRSADAPAYQQGQNQLYNELNLGRREEYDVLDKRRGRDPEMGGKPRRKNPQEGLYNE LQKDKMAEAYSEIGMKGERRRGKGHDGLYQGLSTATKDTYDALHMQALPPR |

In particular embodiments, a CAR comprises an antibody or antigen binding fragment thereof comprising an amino acid sequence set forth in SEQ ID NO: 129; a spacer domain comprising an amino acid sequence set forth in SEQ ID NO: 145, SEQ ID NO: 146, SEQ ID NO: 148, or SEQ ID NO: 150; a transmembrane domain comprising an amino acid sequence set forth in SEQ ID NO: 151 or SEQ ID NO: 153; a costimulatory domain comprising an amino acid sequence set forth in SEQ ID NO: 159, SEQ ID NO: 160, or SEQ ID NO: 162; and a primary signaling domain comprising an amino acid sequence set forth in SEQ ID NO: 158. In particular embodiments, a CAR comprises an amino acid sequence set forth in any one of SEQ ID NOs: 765, 766, 767, 768, 769, 770, 771, 772, 773, 774, 775, 776, 777, 778, 779, 780, 781, 782, 783, 784, 785, 786, 787, and 788.

| SEQ ID NO. | AMINO ACID SEQUENCE |
|---|---|
| 765 | EVQLLESGGGLVQPGGSLRLSCAASGFTFSSYAMSWFRQAPGKEREFVSFISGSGDSTYYADSVK<br>GRFTISRDNSKNTLYLQMNSLRAEDTAVYYCTRWPYDFEEPSEPGVYWGQGTQVTVSSTTTPAPR<br>PPTPAPTIASQPLSLRPEACRPAAGGAVHTRGLDFACDIYIWAPLAGTCGVLLLSLVITLYCKRG<br>RKKLLYIFKQPFMRPVQTTQEEDGCSCRFPEEEEGGCELRVKFSRSADAPAYQQGQNQLYNELNL<br>GRREEYDVLDKRRGRDPEMGGKPRRKNPQEGLYNELQKDKMAEAYSEIGMKGERRRGKGHDGLYQ<br>GLSTATKDTYDALHMQALPPR |
| 766 | EVQLLESGGGLVQPGGSLRLSCAASGFTFSSYAMSWFRQAPGKEREFVSFISGSGDSTYYADSVK<br>GRFTISRDNSKNTLYLQMNSLRAEDTAVYYCTRWPYDFEEPSEPGVYWGQGTQVTVSSTTTPAPR<br>PPTPAPTIASQPLSLRPEACRPAAGGAVHTRGLDFACDIYIWAPLAGTCGVLLLSLVITLYCRSK<br>RSRLLHSDYMNMTPRRPGPTRKHYQPYAPPRDFAAYRSRVKFSRSADAPAYQQGQNQLYNELNLG<br>RREEYDVLDKRRGRDPEMGGKPRRKNPQEGLYNELQKDKMAEAYSEIGMKGERRRGKGHDGLYQG<br>LSTATKDTYDALHMQALPPR |
| 767 | EVQLLESGGGLVQPGGSLRLSCAASGFTFSSYAMSWFRQAPGKEREFVSFISGSGDSTYYADSVK<br>GRFTISRDNSKNTLYLQMNSLRAEDTAVYYCTRWPYDFEEPSEPGVYWGQGTQVTVSSTTTPAPR<br>PPTPAPTIASQPLSLRPEACRPAAGGAVHTRGLDFACDIYIWAPLAGTCGVLLLSLVITLYCTKK<br>KYSSSVHDPNGEYMFMRAVNTAKKSRLTDVTLRVKFSRSADAPAYQQGQNQLYNELNLGRREEYD<br>VLDKRRGRDPEMGGKPRRKNPQEGLYNELQKDKMAEAYSEIGMKGERRRGKGHDGLYQGLSTATK<br>DTYDALHMQALPPR |
| 768 | EVQLLESGGGLVQPGGSLRLSCAASGFTFSSYAMSWFRQAPGKEREFVSFISGSGDSTYYADSVK<br>GRFTISRDNSKNTLYLQMNSLRAEDTAVYYCTRWPYDFEEPSEPGVYWGQGTQVTVSSTTTPAPR<br>PPTPAPTIASQPLSLRPEACRPAAGGAVHTRGLDFACDFWVLVVVGGVLACYSLLVTVAFIIFWV<br>KRGRKKLLYIFKQPFMRPVQTTQEEDGCSCRFPEEEEGGCELRVKFSRSADAPAYQQGQNQLYNE<br>LNLGRREEYDVLDKRRGRDPEMGGKPRRKNPQEGLYNELQKDKMAEAYSEIGMKGERRRGKGHDG<br>LYQGLSTATKDTYDALHMQALPPR |
| 769 | EVQLLESGGGLVQPGGSLRLSCAASGFTFSSYAMSWFRQAPGKEREFVSFISGSGDSTYYADSVK<br>GRFTISRDNSKNTLYLQMNSLRAEDTAVYYCTRWPYDFEEPSEPGVYWGQGTQVTVSSTTTPAPR<br>PPTPAPTIASQPLSLRPEACRPAAGGAVHTRGLDFACDFWVLVVVGGVLACYSLLVTVAFIIFWV<br>RSKRSRLLHSDYMNMTPRRPGPTRKHYQPYAPPRDFAAYRSRVKFSRSADAPAYQQGQNQLYNEL<br>NLGRREEYDVLDKRRGRDPEMGGKPRRKNPQEGLYNELQKDKMAEAYSEIGMKGERRRGKGHDGL<br>YQGLSTATKDTYDALHMQALPPR |
| 770 | EVQLLESGGGLVQPGGSLRLSCAASGFTFSSYAMSWFRQAPGKEREFVSFISGSGDSTYYADSVK<br>GRFTISRDNSKNTLYLQMNSLRAEDTAVYYCTRWPYDFEEPSEPGVYWGQGTQVTVSSTTTPAPR<br>PPTPAPTIASQPLSLRPEACRPAAGGAVHTRGLDFACDFWVLVVVGGVLACYSLLVTVAFIIFWV<br>TKKKYSSSVHDPNGEYMFMRAVNTAKKSRLTDVTLRVKFSRSADAPAYQQGQNQLYNELNLGRRE<br>EYDVLDKRRGRDPEMGGKPRRKNPQEGLYNELQKDKMAEAYSEIGMKGERRRGKGHDGLYQGLST<br>ATKDTYDALHMQALPPR |
| 771 | EVQLLESGGGLVQPGGSLRLSCAASGFTFSSYAMSWFRQAPGKEREFVSFISGSGDSTYYADSVK<br>GRFTISRDNSKNTLYLQMNSLRAEDTAVYYCTRWPYDFEEPSEPGVYWGQGTQVTVSSIEVMYPP<br>PYLDNEKSNGTIIHVKGKHLCPSPLFPGPSKPIYIWAPLAGTCGVLLLSLVITLYCKRGRKKLLY<br>IFKQPFMRPVQTTQEEDGCSCRFPEEEEGGCELRVKFSRSADAPAYQQGQNQLYNELNLGRREEY<br>DVLDKRRGRDPEMGGKPRRKNPQEGLYNELQKDKMAEAYSEIGMKGERRRGKGHDGLYQGLSTAT<br>KDTYDALHMQALPPR |
| 772 | EVQLLESGGGLVQPGGSLRLSCAASGFTFSSYAMSWFRQAPGKEREFVSFISGSGDSTYYADSVK<br>GRFTISRDNSKNTLYLQMNSLRAEDTAVYYCTRWPYDFEEPSEPGVYWGQGTQVTVSSIEVMYPP<br>PYLDNEKSNGTIIHVKGKHLCPSPLFPGPSKPIYIWAPLAGTCGVLLLSLVITLYCRSKRSRLLH<br>SDYMNMTPRRPGPTRKHYQPYAPPRDFAAYRSRVKFSRSADAPAYQQGQNQLYNELNLGRREEYD<br>VLDKRRGRDPEMGGKPRRKNPQEGLYNELQKDKMAEAYSEIGMKGERRRGKGHDGLYQGLSTATK<br>DTYDALHMQALPPR |
| 773 | EVQLLESGGGLVQPGGSLRLSCAASGFTFSSYAMSWFRQAPGKEREFVSFISGSGDSTYYADSVK<br>GRFTISRDNSKNTLYLQMNSLRAEDTAVYYCTRWPYDFEEPSEPGVYWGQGTQVTVSSIEVMYPP<br>PYLDNEKSNGTIIHVKGKHLCPSPLFPGPSKPIYIWAPLAGTCGVLLLSLVITLYCTKKKYSSSV<br>HDPNGEYMFMRAVNTAKKSRLTDVTLRVKFSRSADAPAYQQGQNQLYNELNLGRREEYDVLDKRR<br>GRDPEMGGKPRRKNPQEGLYNELQKDKMAEAYSEIGMKGERRRGKGHDGLYQGLSTATKDTYDAL<br>HMQALPPR |
| 774 | EVQLLESGGGLVQPGGSLRLSCAASGFTFSSYAMSWFRQAPGKEREFVSFISGSGDSTYYADSVK<br>GRFTISRDNSKNTLYLQMNSLRAEDTAVYYCTRWPYDFEEPSEPGVYWGQGTQVTVSSIEVMYPP<br>PYLDNEKSNGTIIHVKGKHLCPSPLFPGPSKPFWVLVVVGGVLACYSLLVTVAFIIFWVKRGRKK |

-continued

| SEQ ID NO. | AMINO ACID SEQUENCE |
|---|---|
| | LLYIFKQPFMRPVQTTQEEDGCSCRFPEEEEGGCELRVKFSRSADAPAYQQGQNQLYNELNLGRR EEYDVLDKRRGRDPEMGGKPRRKNPQEGLYNELQKDKMAEAYSEIGMKGERRRGKGHDGLYQGLS TATKDTYDALHMQALPPR |
| 775 | EVQLLESGGGLVQPGGSLRLSCAASGFTFSSYAMSWFRQAPGKEREFVSFISGSGDSTYYADSVK GRFTISRDNSKNTLYLQMNSLRAEDTAVYYCTRWPYDFEEPSEPGVYWGQGTQVTVSSIEVMYPP PYLDNEKSNGTIIHVKGKHLCPSPLFPGPSKPFWVLVVVGGVLACYSLLVTVAFIIFWVRSKRSR LLHSDYMNMTPRRPGPTRKHYQPYAPPRDFAAYRSRVKFSRSADAPAYQQGQNQLYNELNLGRRE EYDVLDKRRGRDPEMGGKPRRKNPQEGLYNELQKDKMAEAYSEIGMKGERRRGKGHDGLYQGLST ATKDTYDALHMQALPPR |
| 776 | EVQLLESGGGLVQPGGSLRLSCAASGFTFSSYAMSWFRQAPGKEREFVSFISGSGDSTYYADSVK GRFTISRDNSKNTLYLQMNSLRAEDTAVYYCTRWPYDFEEPSEPGVYWGQGTQVTVSSIEVMYPP PYLDNEKSNGTIIHVKGKHLCPSPLFPGPSKPFWVLVVVGGVLACYSLLVTVAFIIFWVTKKKYS SSVHDPNGEYMFMRAVNTAKKSRLTDVTLRVKFSRSADAPAYQQGQNQLYNELNLGRREEYDVLD KRRGRDPEMGGKPRRKNPQEGLYNELQKDKMAEAYSEIGMKGERRRGKGHDGLYQGLSTATKDTY DALHMQALPPR |
| 777 | EVQLLESGGGLVQPGGSLRLSCAASGFTFSSYAMSWFRQAPGKEREFVSFISGSGDSTYYADSVK GRFTISRDNSKNTLYLQMNSLRAEDTAVYYCTRWPYDFEEPSEPGVYWGQGTQVTVSSESKYGPP CPPCPIYIWAPLAGTCGVLLLSLVITLYCKRGRKKLLYIFKQPFMRPVQTTQEEDGCSCRFPEEE EGGCELRVKFSRSADAPAYQQGQNQLYNELNLGRREEYDVLDKRRGRDPEMGGKPRRKNPQEGLY NELQKDKMAEAYSEIGMKGERRRGKGHDGLYQGLSTATKDTYDALHMQALPPR |
| 778 | EVQLLESGGGLVQPGGSLRLSCAASGFTFSSYAMSWFRQAPGKEREFVSFISGSGDSTYYADSVK GRFTISRDNSKNTLYLQMNSLRAEDTAVYYCTRWPYDFEEPSEPGVYWGQGTQVTVSSESKYGPP CPPCPIYIWAPLAGTCGVLLLSLVITLYCRSKRSRLLHSDYMNMTPRRPGPTRKHYQPYAPPRDF AAYRSRVKFSRSADAPAYQQGQNQLYNELNLGRREEYDVLDKRRGRDPEMGGKPRRKNPQEGLYN ELQKDKMAEAYSEIGMKGERRRGKGHDGLYQGLSTATKDTYDALHMQALPPR |
| 779 | EVQLLESGGGLVQPGGSLRLSCAASGFTFSSYAMSWFRQAPGKEREFVSFISGSGDSTYYADSVK GRFTISRDNSKNTLYLQMNSLRAEDTAVYYCTRWPYDFEEPSEPGVYWGQGTQVTVSSESKYGPP CPPCPIYIWAPLAGTCGVLLLSLVITLYCTKKKYSSSVHDPNGEYMFMRAVNTAKKSRLTDVTLR VKFSRSADAPAYQQGQNQLYNELNLGRREEYDVLDKRRGRDPEMGGKPRRKNPQEGLYNELQKDK MAEAYSEIGMKGERRRGKGHDGLYQGLSTATKDTYDALHMQALPPR |
| 780 | EVQLLESGGGLVQPGGSLRLSCAASGFTFSSYAMSWFRQAPGKEREFVSFISGSGDSTYYADSVK GRFTISRDNSKNTLYLQMNSLRAEDTAVYYCTRWPYDFEEPSEPGVYWGQGTQVTVSSESKYGPP CPPCPFWVLVVVGGVLACYSLLVTVAFIIFWVKRGRKKLLYIFKQPEMRPVQTTQEEDGCSCRFP EEEEGGCELRVKFSRSADAPAYQQGQNQLYNELNLGRREEYDVLDKRRGRDPEMGGKPRRKNPQE GLYNELQKDKMAEAYSEIGMKGERRRGKGHDGLYQGLSTATKDTYDALHMQALPPR |
| 781 | EVQLLESGGGLVQPGGSLRLSCAASGFTFSSYAMSWFRQAPGKEREFVSFISGSGDSTYYADSVK GRFTISRDNSKNTLYLQMNSLRAEDTAVYYCTRWPYDFEEPSEPGVYWGQGTQVTVSSESKYGPP CPPCPFWVLVVVGGVLACYSLLVTVAFIIFWVRSKRSRLLHSDYMNMTPRRPGPTRKHYQPYAPP RDFAAYRSRVKFSRSADAPAYQQGQNQLYNELNLGRREEYDVLDKRRGRDPEMGGKPRRKNPQEG LYNELQKDKMAEAYSEIGMKGERRRGKGHDGLYQGLSTATKDTYDALHMQALPPR |
| 782 | EVQLLESGGGLVQPGGSLRLSCAASGFTFSSYAMSWFRQAPGKEREFVSFISGSGDSTYYADSVK GRFTISRDNSKNTLYLQMNSLRAEDTAVYYCTRWPYDFEEPSEPGVYWGQGTQVTVSSESKYGPP CPPCPFWVLVVVGGVLACYSLLVTVAFIIFWVTKKKYSSSVHDPNGEYMFMRAVNTAKKSRLTDV TLRVKFSRSADAPAYQQGQNQLYNELNLGRREEYDVLDKRRGRDPEMGGKPRRKNPQEGLYNELQ KDKMAEAYSEIGMKGERRRGKGHDGLYQGLSTATKDTYDALHMQALPPR |
| 783 | EVQLLESGGGLVQPGGSLRLSCAASGFTFSSYAMSWFRQAPGKEREFVSFISGSGDSTYYADSVK GRFTISRDNSKNTLYLQMNSLRAEDTAVYYCTRWPYDFEEPSEPGVYWGQGTQVTVSSLEPKSCD KTHTCPPCPIYIWAPLAGTCGVLLLSLVITLYCKRGRKKLLYIFKQPEMRPVQTTQEEDGCSCRF PEEEEGGCELRVKFSRSADAPAYQQGQNQLYNELNLGRREEYDVLDKRRGRDPEMGGKPRRKNPQ EGLYNELQKDKMAEAYSEIGMKGERRRGKGHDGLYQGLSTATKDTYDALHMQALPPR |
| 784 | EVQLLESGGGLVQPGGSLRLSCAASGFTFSSYAMSWFRQAPGKEREFVSFISGSGDSTYYADSVK GRFTISRDNSKNTLYLQMNSLRAEDTAVYYCTRWPYDFEEPSEPGVYWGQGTQVTVSSLEPKSCD KTHTCPPCPIYIWAPLAGTCGVLLLSLVITLYCRSKRSRLLHSDYMNMTPRRPGPTRKHYQPYAP PRDFAAYRSRVKFSRSADAPAYQQGQNQLYNELNLGRREEYDVLDKRRGRDPEMGGKPRRKNPQE GLYNELQKDKMAEAYSEIGMKGERRRGKGHDGLYQGLSTATKDTYDALHMQALPPR |
| 785 | EVQLLESGGGLVQPGGSLRLSCAASGFTFSSYAMSWFRQAPGKEREFVSFISGSGDSTYYADSVK GRFTISRDNSKNTLYLQMNSLRAEDTAVYYCTRWPYDFEEPSEPGVYWGQGTQVTVSSLEPKSCD KTHTCPPCPIYIWAPLAGTCGVLLLSLVITLYCTKKKYSSSVHDPNGEYMFMRAVNTAKKSRLTD VTLRVKFSRSADAPAYQQGQNQLYNELNLGRREEYDVLDKRRGRDPEMGGKPRRKNPQEGLYNEL QKDKMAEAYSEIGMKGERRRGKGHDGLYQGLSTATKDTYDALHMQALPPR |
| 786 | EVQLLESGGGLVQPGGSLRLSCAASGFTFSSYAMSWFRQAPGKEREFVSFISGSGDSTYYADSVK GRFTISRDNSKNTLYLQMNSLRAEDTAVYYCTRWPYDFEEPSEPGVYWGQGTQVTVSSLEPKSCD KTHTCPPCPFWVLVVVGGVLACYSLLVTVAFIIFWVKRGRKKLLYIFKQPEMRPVQTTQEEDGCS |

-continued

| SEQ ID NO. | AMINO ACID SEQUENCE |
|---|---|
| | CRFPEEEEGGCELRVKFSRSADAPAYQQGQNQLYNELNLGRREEYDVLDKRRGRDPEMGGKPRRK NPQEGLYNELQKDKMAEAYSEIGMKGERRRGKGHDGLYQGLSTATKDTYDALHMQALPPR |
| 787 | EVQLLESGGGLVQPGGSLRLSCAASGFTFSSYAMSWFRQAPGKEREFVSFISGSGDSTYYADSVK GRFTISRDNSKNTLYLQMNSLRAEDTAVYYCTRWPYDFEEPSEPGVYWGQGTQVTVSSLEPKSCD KTHTCPPCPFWVLVVVGGVLACYSLLVTVAFIIFWVRSKRSRLLHSDYMNMTPRRPGPTRKHYQP YAPPRDFAAYRSRVKFSRSADAPAYQQGQNQLYNELNLGRREEYDVLDKRRGRDPEMGGKPRRKN PQEGLYNELQKDKMAEAYSEIGMKGERRRGKGHDGLYQGLSTATKDTYDALHMQALPPR |
| 788 | EVQLLESGGGLVQPGGSLRLSCAASGFTFSSYAMSWFRQAPGKEREFVSFISGSGDSTYYADSVK GRFTISRDNSKNTLYLQMNSLRAEDTAVYYCTRWPYDFEEPSEPGVYWGQGTQVTVSSLEPKSCD KTHTCPPCPFWVLVVVGGVLACYSLLVTVAFIIFWVTKKKYSSSVHDPNGEYMFMRAVNTAKKSR LTDVTLRVKFSRSADAPAYQQGQNQLYNELNLGRREEYDVLDKRRGRDPEMGGKPRRKNPQEGLY NELQKDKMAEAYSEIGMKGERRRGKGHDGLYQGLSTATKDTYDALHMQALPPR |

In particular embodiments, a CAR comprises an antibody or antigen binding fragment thereof comprising an amino acid sequence set forth in SEQ ID NO: 133; a spacer domain comprising an amino acid sequence set forth in SEQ ID NO: 145, SEQ ID NO: 146, SEQ ID NO: 148, or SEQ ID NO: 150; a transmembrane domain comprising an amino acid sequence set forth in SEQ ID NO: 151 or SEQ ID NO: 153; a costimulatory domain comprising an amino acid sequence set forth in SEQ ID NO: 159, SEQ ID NO: 160, or SEQ ID NO: 162; and a primary signaling domain comprising an amino acid sequence set forth in SEQ ID NO: 158. In particular embodiments, a CAR comprises an amino acid sequence set forth in any one of SEQ ID NOs: 789, 790, 791, 792, 793, 794, 795, 796, 797, 798, 799, 800, 801, 802, 803, 804, 805, 806, 807, 808, 809, 810, 811, and 812.

| SEQ ID NO. | AMINO ACID SEQUENCE |
|---|---|
| 789 | EVQLLESGGGLVQPGGSLRLSCAASGFTFTDYDMSWYRQAPGKERELVSVIHSGGSTYYADSVKG RFTISRDNSKNTLYLQMNSLRAEDTAVYYCAPGYYSDLSFDYYNFDYWGQGTQVTVSSTTTPAPR PPTPAPTIASQPLSLRPEACRPAAGGAVHTRGLDFACDIYIWAPLAGTCGVLLLSLVITLYCKRG RKKLLYIFKQPFMRPVQTTQEEDGCSCRFPEEEEGGCELRVKFSRSADAPAYQQGQNQLYNELNL GRREEYDVLDKRRGRDPEMGGKPRRKNPQEGLYNELQKDKMAEAYSEIGMKGERRRGKGHDGLYQ GLSTATKDTYDALHMQALPPR |
| 790 | EVQLLESGGGLVQPGGSLRLSCAASGFTFTDYDMSWYRQAPGKERELVSVIHSGGSTYYADSVKG RFTISRDNSKNTLYLQMNSLRAEDTAVYYCAPGYYSDLSFDYYNFDYWGQGTQVTVSSTTTPAPR PPTPAPTIASQPLSLRPEACRPAAGGAVHTRGLDFACDIYIWAPLAGTCGVLLLSLVITLYCRSK RSRLLHSDYMNMTPRRPGPTRKHYQPYAPPRDFAAYRSRVKFSRSADAPAYQQGQNQLYNELNLG RREEYDVLDKRRGRDPEMGGKPRRKNPQEGLYNELQKDKMAEAYSEIGMKGERRRGKGHDGLYQG LSTATKDTYDALHMQALPPR |
| 791 | EVQLLESGGGLVQPGGSLRLSCAASGFTFTDYDMSWYRQAPGKERELVSVIHSGGSTYYADSVKG RFTISRDNSKNTLYLQMNSLRAEDTAVYYCAPGYYSDLSFDYYNFDYWGQGTQVTVSSTTTPAPR PPTPAPTIASQPLSLRPEACRPAAGGAVHTRGLDFACDIYIWAPLAGTCGVLLLSLVITLYCTKK KYSSSVHDPNGEYMFMRAVNTAKKSRLTDVTLRVKFSRSADAPAYQQGQNQLYNELNLGRREEYD VLDKRRGRDPEMGGKPRRKNPQEGLYNELQKDKMAEAYSEIGMKGERRRGKGHDGLYQGLSTATK DTYDALHMQALPPR |
| 792 | EVQLLESGGGLVQPGGSLRLSCAASGFTFTDYDMSWYRQAPGKERELVSVIHSGGSTYYADSVKG RFTISRDNSKNTLYLQMNSLRAEDTAVYYCAPGYYSDLSFDYYNFDYWGQGTQVTVSSTTTPAPR PPTPAPTIASQPLSLRPEACRPAAGGAVHTRGLDFACDFWVLVVVGGVLACYSLLVTVAFIIFWV KRGRKKLLYIFKQPFMRPVQTTQEEDGCSCRFPEEEEGGCELRVKFSRSADAPAYQQGQNQLYNE LNLGRREEYDVLDKRRGRDPEMGGKPRRKNPQEGLYNELQKDKMAEAYSEIGMKGERRRGKGHDG LYQGLSTATKDTYDALHMQALPPR |
| 793 | EVQLLESGGGLVQPGGSLRLSCAASGFTFTDYDMSWYRQAPGKERELVSVIHSGGSTYYADSVKG RFTISRDNSKNTLYLQMNSLRAEDTAVYYCAPGYYSDLSFDYYNFDYWGQGTQVTVSSTTTPAPR PPTPAPTIASQPLSLRPEACRPAAGGAVHTRGLDFACDFWVLVVVGGVLACYSLLVTVAFIIFWV RSKRSRLLHSDYMNMTPRRPGPTRKHYQPYAPPRDFAAYRSRVKFSRSADAPAYQQGQNQLYNEL NLGRREEYDVLDKRRGRDPEMGGKPRRKNPQEGLYNELQKDKMAEAYSEIGMKGERRRGKGHDGL YQGLSTATKDTYDALHMQALPPR |
| 794 | EVQLLESGGGLVQPGGSLRLSCAASGFTFTDYDMSWYRQAPGKERELVSVIHSGGSTYYADSVKG RFTISRDNSKNTLYLQMNSLRAEDTAVYYCAPGYYSDLSFDYYNFDYWGQGTQVTVSSTTTPAPR PPTPAPTIASQPLSLRPEACRPAAGGAVHTRGLDFACDFWVLVVVGGVLACYSLLVTVAFIIFWV TKKKYSSSVHDPNGEYMFMRAVNTAKKSRLTDVTLRVKFSRSADAPAYQQGQNQLYNELNLGRRE EYDVLDKRRGRDPEMGGKPRRKNPQEGLYNELQKDKMAEAYSEIGMKGERRRGKGHDGLYQGLST ATKDTYDALHMQALPPR |

-continued

| SEQ ID NO. | AMINO ACID SEQUENCE |
|---|---|
| 795 | EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 796 | EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 797 | EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 798 | EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 799 | EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 800 | EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 801 | EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 802 | EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 803 | EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 804 | EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 805 | EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSESKYGPPCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 806 | EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSESKYGPP |

-continued

| SEQ ID NO. | AMINO ACID SEQUENCE |
| --- | --- |
| | CPPCPFWVLVVVGGVLACYSLLVTVAFIIFWVTKKKYSSSVHDPNGEYMFMRAVNTAKKSRLTDV<br>TLRVKFSRSADAPAYQQGQNQLYNELNLGRREEYDVLDKRRGRDPEMGGKPRRKNPQEGLYNELQ<br>KDKMAEAYSEIGMKGERRRGKGHDGLYQGLSTATKDTYDALHMQALPPR |
| 807 | EVQLLESGGGLVQPGGSLRLSCAASGFTFTDYDMSWYRQAPGKERELVSVIHSGGSTYYADSVKG<br>RFTISRDNSKNTLYLQMNSLRAEDTAVYYCAPGYYSDLSFDYYNFDYWGQGTQVTVSSLEPKSCD<br>KTHTCPPCPIYIWAPLAGTCGVLLLSLVITLYCKRGRKKLLYIFKQPFMRPVQTTQEEDGCSCRF<br>PEEEEGGCELRVKFSRSADAPAYQQGQNQLYNELNLGRREEYDVLDKRRGRDPEMGGKPRRKNPQ<br>EGLYNELQKDKMAEAYSEIGMKGERRRGKGHDGLYQGLSTATKDTYDALHMQALPPR |
| 808 | EVQLLESGGGLVQPGGSLRLSCAASGFTFTDYDMSWYRQAPGKERELVSVIHSGGSTYYADSVKG<br>RFTISRDNSKNTLYLQMNSLRAEDTAVYYCAPGYYSDLSFDYYNFDYWGQGTQVTVSSLEPKSCD<br>KTHTCPPCPIYIWAPLAGTCGVLLLSLVITLYCRSKRSRLLHSDYMNMTPRRPGPTRKHYQPYAP<br>PRDFAAYRSRVKFSRSADAPAYQQGQNQLYNELNLGRREEYDVLDKRRGRDPEMGGKPRRKNPQE<br>GLYNELQKDKMAEAYSEIGMKGERRRGKGHDGLYQGLSTATKDTYDALHMQALPPR |
| 809 | EVQLLESGGGLVQPGGSLRLSCAASGFTFTDYDMSWYRQAPGKERELVSVIHSGGSTYYADSVKG<br>RFTISRDNSKNTLYLQMNSLRAEDTAVYYCAPGYYSDLSFDYYNFDYWGQGTQVTVSSLEPKSCD<br>KTHTCPPCPIYIWAPLAGTCGVLLLSLVITLYCTKKKYSSSVHDPNGEYMFMRAVNTAKKSRLTD<br>VTLRVKFSRSADAPAYQQGQNQLYNELNLGRREEYDVLDKRRGRDPEMGGKPRRKNPQEGLYNEL<br>QKDKMAEAYSEIGMKGERRRGKGHDGLYQGLSTATKDTYDALHMQALPPR |
| 810 | EVQLLESGGGLVQPGGSLRLSCAASGFTFTDYDMSWYRQAPGKERELVSVIHSGGSTYYADSVKG<br>RFTISRDNSKNTLYLQMNSLRAEDTAVYYCAPGYYSDLSFDYYNFDYWGQGTQVTVSSLEPKSCD<br>KTHTCPPCPFWVLVVVGGVLACYSLLVTVAFIIFWVKRGRKKLLYIFKQPFMRPVQTTQEEDGCS<br>CRFPEEEEGGCELRVKFSRSADAPAYQQGQNQLYNELNLGRREEYDVLDKRRGRDPEMGGKPRRK<br>NPQEGLYNELQKDKMAEAYSEIGMKGERRRGKGHDGLYQGLSTATKDTYDALHMQALPPR |
| 811 | EVQLLESGGGLVQPGGSLRLSCAASGFTFTDYDMSWYRQAPGKERELVSVIHSGGSTYYADSVKG<br>RFTISRDNSKNTLYLQMNSLRAEDTAVYYCAPGYYSDLSFDYYNFDYWGQGTQVTVSSLEPKSCD<br>KTHTCPPCPFWVLVVVGGVLACYSLLVTVAFIIFWVRSKRSRLLHSDYMNMTPRRPGPTRKHYQP<br>YAPPRDFAAYRSRVKFSRSADAPAYQQGQNQLYNELNLGRREEYDVLDKRRGRDPEMGGKPRRKN<br>PQEGLYNELQKDKMAEAYSEIGMKGERRRGKGHDGLYQGLSTATKDTYDALHMQALPPR |
| 812 | EVQLLESGGGLVQPGGSLRLSCAASGFTFTDYDMSWYRQAPGKERELVSVIHSGGSTYYADSVKG<br>RFTISRDNSKNTLYLQMNSLRAEDTAVYYCAPGYYSDLSFDYYNFDYWGQGTQVTVSSLEPKSCD<br>KTHTCPPCPFWVLVVVGGVLACYSLLVTVAFIIFWVTKKKYSSSVHDPNGEYMFMRAVNTAKKSR<br>LTDVTLRVKFSRSADAPAYQQGQNQLYNELNLGRREEYDVLDKRRGRDPEMGGKPRRKNPQEGLY<br>NELQKDKMAEAYSEIGMKGERRRGKGHDGLYQGLSTATKDTYDALHMQALPPR |

In particular embodiments, a CAR comprises an antibody or antigen binding fragment thereof comprising an amino acid sequence set forth in SEQ ID NO: 137; a spacer domain comprising an amino acid sequence set forth in SEQ ID NO: 145, SEQ ID NO: 146, SEQ ID NO: 148, or SEQ ID NO: 150; a transmembrane domain comprising an amino acid sequence set forth in SEQ ID NO: 151 or SEQ ID NO: 153; a costimulatory domain comprising an amino acid sequence set forth in SEQ ID NO: 159, SEQ ID NO: 160, or SEQ ID NO: 162; and a primary signaling domain comprising an amino acid sequence set forth in SEQ ID NO: 158. In particular embodiments, a CAR comprises an amino acid sequence set forth in any one of SEQ ID NOs: 813, 814, 815, 816, 817, 818, 819, 820, 821, 822, 823, 824, 825, 826, 827, 828, 829, 830, 831, 832, 833, 834, 835, and 836.

| SEQ ID NO. | AMINO ACID SEQUENCE |
| --- | --- |
| 813 | EVQLLESGGGLVQPGGSLRLSCAASGFTFSDYAMHWFRQAPGKERVLVSSIDSGGSTYYADSVKG<br>RFTISRDNSKNTLYLQMNSLRAEDTAVYYCNAGFKGDHPHPKDAFDIWGQGTQVTVSSTTTPAPR<br>PPTPAPTIASQPLSLRPEACRPAAGGAVHTRGLDFACDIYIWAPLAGTCGVLLLSLVITLYCKRG<br>RKKLLYIFKQPFMRPVQTTQEEDGCSCRFPEEEEGGCELRVKESRSADAPAYQQGQNQLYNELNL<br>GRREEYDVLDKRRGRDPEMGGKPRRKNPQEGLYNELQKDKMAEAYSEIGMKGERRRGKGHDGLYQ<br>GLSTATKDTYDALHMQALPPR |
| 814 | EVQLLESGGGLVQPGGSLRLSCAASGFTFSDYAMHWFRQAPGKERVLVSSIDSGGSTYYADSVKG<br>RFTISRDNSKNTLYLQMNSLRAEDTAVYYCNAGFKGDHPHPKDAFDIWGQGTQVTVSSTTTPAPR<br>PPTPAPTIASQPLSLRPEACRPAAGGAVHTRGLDFACDIYIWAPLAGTCGVLLLSLVITLYCRSK<br>RSRLLHSDYMNMTPRRPGPTRKHYQPYAPPRDFAAYRSRVKFSRSADAPAYQQGQNQLYNELNLG<br>RREEYDVLDKRRGRDPEMGGKPRRKNPQEGLYNELQKDKMAEAYSEIGMKGERRRGKGHDGLYQG<br>LSTATKDTYDALHMQALPPR |
| 815 | EVQLLESGGGLVQPGGSLRLSCAASGFTFSDYAMHWFRQAPGKERVLVSSIDSGGSTYYADSVKG<br>RFTISRDNSKNTLYLQMNSLRAEDTAVYYCNAGFKGDHPHPKDAFDIWGQGTQVTVSSTTTPAPR<br>PPTPAPTIASQPLSLRPEACRPAAGGAVHTRGLDFACDIYIWAPLAGTCGVLLLSLVITLYCTKK<br>KYSSSVHDPNGEYMFMRAVNTAKKSRLTDVTLRVKFSRSADAPAYQQGQNQLYNELNLGRREEYD |

-continued

| SEQ ID NO. | AMINO ACID SEQUENCE |
|---|---|
| | VLDKRRGRDPEMGGKPRRKNPQEGLYNELQKDKMAEAYSEIGMKGERRRGKGHDGLYQGLSTATKDTYDALHMQALPPR |
| 816 | EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 817 | EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 818 | EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 819 | EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 820 | EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 821 | EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 822 | EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKESRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 823 | EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 824 | EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 825 | EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 826 | EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSESKYGPPCPPCPIYIWAPLAGTCGVLLLSLVITLYCRSKRSRLLHSDYMNMTPRRPGPTRKHYQPYAPPRDF |

-continued

| SEQ ID NO. | AMINO ACID SEQUENCE |
|---|---|
| | AAYRSRVKFSRSADAPAYQQGQNQLYNELNLGRREEYDVLDKRRGRDPEMGGKPRRKNPQEGLYN ELQKDKMAEAYSEIGMKGERRRGKGHDGLYQGLSTATKDTYDALHMQALPPR |
| 827 | EVQLLESGGGLVQPGGSLRLSCAASGFTFSDYAMHWFRQAPGKERVLVSSIDSGGSTYYADSVKG RFTISRDNSKNTLYLQMNSLRAEDTAVYYCNAGFKGDHPHPKDAFDIWGQGTQVTVSSESKYGPP CPPCPIYIWAPLAGTCGVLLLSLVITLYCTKKKYSSSVHDPNGEYMFMRAVNTAKKSRLTDVTLR VKFSRSADAPAYQQGQNQLYNELNLGRREEYDVLDKRRGRDPEMGGKPRRKNPQEGLYNELQKDK MAEAYSEIGMKGERRRGKGHDGLYQGLSTATKDTYDALHMQALPPR |
| 828 | EVQLLESGGGLVQPGGSLRLSCAASGFTFSDYAMHWFRQAPGKERVLVSSIDSGGSTYYADSVKG RFTISRDNSKNTLYLQMNSLRAEDTAVYYCNAGFKGDHPHPKDAFDIWGQGTQVTVSSESKYGPP CPPCPFWVLVVVGGVLACYSLLVTVAFIIFWVKRGRKKLLYIFKQPFMRPVQTTQEEDGCSCRFP EEEEGGCELRVKFSRSADAPAYQQGQNQLYNELNLGRREEYDVLDKRRGRDPEMGGKPRRKNPQE GLYNELQKDKMAEAYSEIGMKGERRRGKGHDGLYQGLSTATKDTYDALHMQALPPR |
| 829 | EVQLLESGGGLVQPGGSLRLSCAASGFTFSDYAMHWFRQAPGKERVLVSSIDSGGSTYYADSVKG RFTISRDNSKNTLYLQMNSLRAEDTAVYYCNAGFKGDHPHPKDAFDIWGQGTQVTVSSESKYGPP CPPCPFWVLVVVGGVLACYSLLVTVAFIIFWVRSKRSRLLHSDYMNMTPRRPGPTRKHYQPYAPP RDFAAYRSRVKFSRSADAPAYQQGQNQLYNELNLGRREEYDVLDKRRGRDPEMGGKPRRKNPQEG LYNELQKDKMAEAYSEIGMKGERRRGKGHDGLYQGLSTATKDTYDALHMQALPPR |
| 830 | EVQLLESGGGLVQPGGSLRLSCAASGFTFSDYAMHWFRQAPGKERVLVSSIDSGGSTYYADSVKG RFTISRDNSKNTLYLQMNSLRAEDTAVYYCNAGFKGDHPHPKDAFDIWGQGTQVTVSSESKYGPP CPPCPFWVLVVVGGVLACYSLLVTVAFIIFWVTKKKYSSSVHDPNGEYMFMRAVNTAKKSRLTDV TLRVKFSRSADAPAYQQGQNQLYNELNLGRREEYDVLDKRRGRDPEMGGKPRRKNPQEGLYNELQ KDKMAEAYSEIGMKGERRRGKGHDGLYQGLSTATKDTYDALHMQALPPR |
| 831 | EVQLLESGGGLVQPGGSLRLSCAASGFTFSDYAMHWFRQAPGKERVLVSSIDSGGSTYYADSVKG RFTISRDNSKNTLYLQMNSLRAEDTAVYYCNAGFKGDHPHPKDAFDIWGQGTQVTVSSLEPKSCD KTHTCPPCPIYIWAPLAGTCGVLLLSLVITLYCKRGRKKLLYIFKQPFMRPVQTTQEEDGCSCRF PEEEEGGCELRVKFSRSADAPAYQQGQNQLYNELNLGRREEYDVLDKRRGRDPEMGGKPRRKNPQ EGLYNELQKDKMAEAYSEIGMKGERRRGKGHDGLYQGLSTATKDTYDALHMQALPPR |
| 832 | EVQLLESGGGLVQPGGSLRLSCAASGFTFSDYAMHWFRQAPGKERVLVSSIDSGGSTYYADSVKG RFTISRDNSKNTLYLQMNSLRAEDTAVYYCNAGFKGDHPHPKDAFDIWGQGTQVTVSSLEPKSCD KTHTCPPCPIYIWAPLAGTCGVLLLSLVITLYCRSKRSRLLHSDYMNMTPRRPGPTRKHYQPYAP PRDFAAYRSRVKFSRSADAPAYQQGQNQLYNELNLGRREEYDVLDKRRGRDPEMGGKPRRKNPQE GLYNELQKDKMAEAYSEIGMKGERRRGKGHDGLYQGLSTATKDTYDALHMQALPPR |
| 833 | EVQLLESGGGLVQPGGSLRLSCAASGFTFSDYAMHWFRQAPGKERVLVSSIDSGGSTYYADSVKG RFTISRDNSKNTLYLQMNSLRAEDTAVYYCNAGFKGDHPHPKDAFDIWGQGTQVTVSSLEPKSCD KTHTCPPCPIYIWAPLAGTCGVLLLSLVITLYCTKKKYSSSVHDPNGEYMFMRAVNTAKKSRLTD VTLRVKFSRSADAPAYQQGQNQLYNELNLGRREEYDVLDKRRGRDPEMGGKPRRKNPQEGLYNEL QKDKMAEAYSEIGMKGERRRGKGHDGLYQGLSTATKDTYDALHMQALPPR |
| 834 | EVQLLESGGGLVQPGGSLRLSCAASGFTFSDYAMHWFRQAPGKERVLVSSIDSGGSTYYADSVKG RFTISRDNSKNTLYLQMNSLRAEDTAVYYCNAGFKGDHPHPKDAFDIWGQGTQVTVSSLEPKSCD KTHTCPPCPFWVLVVVGGVLACYSLLVTVAFIIFWVKRGRKKLLYIFKQPFMRPVQTTQEEDGCS CRFPEEEEGGCELRVKFSRSADAPAYQQGQNQLYNELNLGRREEYDVLDKRRGRDPFMGGKPRRK NPQEGLYNELQKDKMAEAYSEIGMKGERRRGKGHDGLYQGLSTATKDTYDALHMQALPPR |
| 835 | EVQLLESGGGLVQPGGSLRLSCAASGFTFSDYAMHWFRQAPGKERVLVSSIDSGGSTYYADSVKG RFTISRDNSKNTLYLQMNSLRAEDTAVYYCNAGFKGDHPHPKDAFDIWGQGTQVTVSSLEPKSCD KTHTCPPCPFWVLVVVGGVLACYSLLVTVAFIIFWVRSKRSRLLHSDYMNMTPRRPGPTRKHYQP YAPPRDFAAYRSRVKFSRSADAPAYQQGQNQLYNELNLGRREEYDVLDKRRGRDPFMGGKPRRKN PQEGLYNELQKDKMAEAYSEIGMKGERRRGKGHDGLYQGLSTATKDTYDALHMQALPPR |
| 836 | EVQLLESGGGLVQPGGSLRLSCAASGFTFSDYAMHWFRQAPGKERVLVSSIDSGGSTYYADSVKG RFTISRDNSKNTLYLQMNSLRAEDTAVYYCNAGFKGDHPHPKDAFDIWGQGTQVTVSSLEPKSCD KTHTCPPCPFWVLVVVGGVLACYSLLVTVAFIIFWVTKKKYSSSVHDPNGEYMFMRAVNTAKKSR LTDVTLRVKFSRSADAPAYQQGQNQLYNELNLGRREEYDVLDKRRGRDPFMGGKPRRKNPQEGLY NELQKDKMAEAYSEIGMKGERRRGKGHDGLYQGLSTATKDTYDALHMQALPPR |

In particular embodiments, a CAR comprises an antibody or antigen binding fragment thereof comprising an amino acid sequence set forth in SEQ ID NO: 141; a spacer domain comprising an amino acid sequence set forth in SEQ ID NO: 145, SEQ ID NO: 146, SEQ ID NO: 148, or SEQ ID NO: 150; a transmembrane domain comprising an amino acid sequence set forth in SEQ ID NO: 151 or SEQ ID NO: 153; a costimulatory domain comprising an amino acid sequence set forth in SEQ ID NO: 159, SEQ ID NO: 160, or SEQ ID NO: 162; and a primary signaling domain comprising an amino acid sequence set forth in SEQ ID NO: 158. In particular embodiments, a CAR comprises an amino acid sequence set forth in any one of SEQ ID NOs: 837, 838, 839, 840, 841, 842, 843, 844, 845, 846, 847, 848, 849, 850, 851, 852, 853, 854, 855, 856, 857, 858, 859, and 860.

| SEQ ID NO. | AMINO ACID SEQUENCE |
|---|---|
| 837 | EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 838 | EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 839 | EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 840 | EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 841 | EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 842 | EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 843 | EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPFMGGKPRRKNPQEGLYNELQKDKMAEAYSEIGMKGERRRGKGHDGLYQGLSTATKDTYDALHMQALPPR |
| 844 | EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 845 | EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| 846 | EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSIEVMYPPPYLDNEKSNGTIIHVKGKHLCPSPLFPGPSKPFWVLVVVGGVLACYSLLVTVAFIIFWVKRGR |

| SEQ ID NO. | AMINO ACID SEQUENCE |
|---|---|
| | KKLLYIFKQPFMRPVQTTQEEDGCSCRFPEEEEGGCELRVKFSRSADAPAYQQGQNQLYNELNLG RREEYDVLDKRRGRDPEMGGKPRRKNPQEGLYNELQKDKMAEAYSEIGMKGERRRGKGHDGLYQG LSTATKDTYDALHMQALPPR |
| 847 | EVQLLESGGGLVQPGGSLRLSCAASGFTFSSEGMSWVRQAPGKERELVSAISGSGDHTYYADSVR GRFTISRDNSKNTLYLQMNSLRAEDTAVYYCNALEGGPTTAIQPGGPDYWGQGTQVTVSSIEVMY PPPYLDNEKSNGTIIHVKGKHLCPSPLFPGPSKPFWVLVVVGGVLACYSLLVTVAFIIFWVRSKR SRLLHSDYMNMTPRRPGPTRKHYQPYAPPRDFAAYRSRVKFSRSADAPAYQQGQNQLYNELNLGR REEYDVLDKRRGRDPEMGGKPRRKNPQEGLYNELQKDKMAEAYSEIGMKGERRRGKGHDGLYQGL STATKDTYDALHMQALPPR |
| 848 | EVQLLESGGGLVQPGGSLRLSCAASGFTFSSEGMSWVRQAPGKERELVSAISGSGDHTYYADSVR GRFTISRDNSKNTLYLQMNSLRAEDTAVYYCNALEGGPTTAIQPGGPDYWGQGTQVTVSSIEVMY PPPYLDNEKSNGTIIHVKGKHLCPSPLFPGPSKPFWVLVVVGGVLACYSLLVTVAFIIFWVTKKK YSSSVHDPNGEYMFMRAVNTAKKSRLTDVTLRVKFSRSADAPAYQQGQNQLYNELNLGRREEYDV LDKRRGRDPEMGGKPRRKNPQEGLYNELQKDKMAEAYSEIGMKGERRRGKGHDGLYQGLSTATKD TYDALHMQALPPR |
| 849 | EVQLLESGGGLVQPGGSLRLSCAASGFTFSSEGMSWVRQAPGKERELVSAISGSGDHTYYADSVR GRFTISRDNSKNTLYLQMNSLRAEDTAVYYCNALEGGPTTAIQPGGPDYWGQGTQVTVSSESKYG PPCPPCPIYIWAPLAGTCGVLLLSLVITLYCKRGRKKLLYIFKQPFMRPVQTTQEEDGCSCRFPE EEEGGCELRVKFSRSADAPAYQQGQNQLYNELNLGRREEYDVLDKRRGRDPEMGGKPRRKNPQEG LYNELQKDKMAEAYSEIGMKGERRRGKGHDGLYQGLSTATKDTYDALHMQALPPR |
| 850 | EVQLLESGGGLVQPGGSLRLSCAASGFTFSSEGMSWVRQAPGKERELVSAISGSGDHTYYADSVR GRFTISRDNSKNTLYLQMNSLRAEDTAVYYCNALEGGPTTAIQPGGPDYWGQGTQVTVSSESKYG PPCPPCPIYIWAPLAGTCGVLLLSLVITLYCRSKRSRLLHSDYMNMTPRRPGPTRKHYQPYAPPR DFAAYRSRVKFSRSADAPAYQQGQNQLYNELNLGRREEYDVLDKRRGRDPEMGGKPRRKNPQEGL YNELQKDKMAEAYSEIGMKGERRRGKGHDGLYQGLSTATKDTYDALHMQALPPR |
| 851 | EVQLLESGGGLVQPGGSLRLSCAASGFTFSSEGMSWVRQAPGKERELVSAISGSGDHTYYADSVR GRFTISRDNSKNTLYLQMNSLRAEDTAVYYCNALEGGPTTAIQPGGPDYWGQGTQVTVSSESKYG PPCPPCPIYIWAPLAGTCGVLLLSLVITLYCTKKKYSSSVHDPNGEYMFMRAVNTAKKSRLTDVT LRVKFSRSADAPAYQQGQNQLYNELNLGRREEYDVLDKRRGRDPEMGGKPRRKNPQEGLYNELQK DKMAEAYSEIGMKGERRRGKGHDGLYQGLSTATKDTYDALHMQALPPR |
| 852 | EVQLLESGGGLVQPGGSLRLSCAASGFTFSSEGMSWVRQAPGKERELVSAISGSGDHTYYADSVR GRFTISRDNSKNTLYLQMNSLRAEDTAVYYCNALEGGPTTAIQPGGPDYWGQGTQVTVSSESKYG PPCPPCPFWVLVVVGGVLACYSLLVTVAFIIFWVKRGRKKLLYIFKQPFMRPVQTTQEEDGCSCR FPEEEEGGCELRVKFSRSADAPAYQQGQNQLYNELNLGRREEYDVLDKRRGRDPEMGGKPRRKNP QEGLYNELQKDKMAEAYSEIGMKGERRRGKGHDGLYQGLSTATKDTYDALHMQALPPR |
| 853 | EVQLLESGGGLVQPGGSLRLSCAASGFTFSSEGMSWVRQAPGKERELVSAISGSGDHTYYADSVR GRFTISRDNSKNTLYLQMNSLRAEDTAVYYCNALEGGPTTAIQPGGPDYWGQGTQVTVSSESKYG PPCPPCPFWVLVVVGGVLACYSLLVTVAFIIFWVRSKRSRLLHSDYMNMTPRRPGPTRKHYQPYA PPRDFAAYRSRVKFSRSADAPAYQQGQNQLYNELNLGRREEYDVLDKRRGRDPEMGGKPRRKNPQ EGLYNELQKDKMAEAYSEIGMKGERRRGKGHDGLYQGLSTATKDTYDALHMQALPPR |
| 854 | EVQLLESGGGLVQPGGSLRLSCAASGFTFSSEGMSWVRQAPGKERELVSAISGSGDHTYYADSVR GRFTISRDNSKNTLYLQMNSLRAEDTAVYYCNALEGGPTTAIQPGGPDYWGQGTQVTVSSESKYG PPCPPCPFWVLVVVGGVLACYSLLVTVAFIIFWVTKKKYSSSVHDPNGEYMFMRAVNTAKKSRLT DVTLRVKFSRSADAPAYQQGQNQLYNELNLGRREEYDVLDKRRGRDPEMGGKPRRKNPQEGLYNE LQKDKMAEAYSEIGMKGERRRGKGHDGLYQGLSTATKDTYDALHMQALPPR |
| 855 | EVQLLESGGGLVQPGGSLRLSCAASGFTFSSEGMSWVRQAPGKERELVSAISGSGDHTYYADSVR GRFTISRDNSKNTLYLQMNSLRAEDTAVYYCNALEGGPTTAIQPGGPDYWGQGTQVTVSSLEPKS CDKTHTCPPCPIYIWAPLAGTCGVLLLSLVITLYCKRGRKKLLYIFKQPFMRPVQTTQEEDGCSC RFPEEEEGGCELRVKFSRSADAPAYQQGQNQLYNELNLGRREEYDVLDKRRGRDPEMGGKPRRKN PQEGLYNELQKDKMAEAYSEIGMKGERRRGKGHDGLYQGLSTATKDTYDALHMQALPPR |
| 856 | EVQLLESGGGLVQPGGSLRLSCAASGFTFSSEGMSWVRQAPGKERELVSAISGSGDHTYYADSVR GRFTISRDNSKNTLYLQMNSLRAEDTAVYYCNALEGGPTTAIQPGGPDYWGQGTQVTVSSLEPKS CDKTHTCPPCPIYIWAPLAGTCGVLLLSLVITLYCRSKRSRLLHSDYMNMTPRRPGPTRKHYQPY APPRDFAAYRSRVKFSRSADAPAYQQGQNQLYNELNLGRREEYDVLDKRRGRDPEMGGKPRRKNP QEGLYNELQKDKMAEAYSEIGMKGERRRGKGHDGLYQGLSTATKDTYDALHMQALPPR |
| 857 | EVQLLESGGGLVQPGGSLRLSCAASGFTFSSEGMSWVRQAPGKERELVSAISGSGDHTYYADSVR GRFTISRDNSKNTLYLQMNSLRAEDTAVYYCNALEGGPTTAIQPGGPDYWGQGTQVTVSSLEPKS CDKTHTCPPCPIYIWAPLAGTCGVLLLSLVITLYCTKKKYSSSVHDPNGEYMFMRAVNTAKKSRL TDVTLRVKFSRSADAPAYQQGQNQLYNELNLGRREEYDVLDKRRGRDPEMGGKPRRKNPQEGLYN ELQKDKMAEAYSEIGMKGERRRGKGHDGLYQGLSTATKDTYDALHMQALPPR |
| 858 | EVQLLESGGGLVQPGGSLRLSCAASGFTFSSEGMSWVRQAPGKERELVSAISGSGDHTYYADSVR GRFTISRDNSKNTLYLQMNSLRAEDTAVYYCNALEGGPTTAIQPGGPDYWGQGTQVTVSSLEPKS CDKTHTCPPCPFWVLVVVGGVLACYSLLVTVAFIIFWVKRGRKKLLYIFKQPFMRPVQTTQEEDG |

-continued

| SEQ ID NO. | AMINO ACID SEQUENCE |
|---|---|
| | CSCRFPEEEEGGCELRVKFSRSADAPAYQQGQNQLYNELNLGRREEYDVLDKRRGRDPEMGGKPR RKNPQEGLYNELQKDKMAEAYSEIGMKGERRRGKGHDGLYQGLSTATKDTYDALHMQALPPR |
| 859 | EVQLLESGGGLVQPGGSLRLSCAASGFTFSSEGMSWVRQAPGKERELVSAISGSGDHTYYADSVR GRFTISRDNSKNTLYLQMNSLRAEDTAVYYCNALEGGPTTAIQPGGPDYWGQGTQVTVSSLEPKS CDKTHTCPPCPFWVLVVVGGVLACYSLLVTVAFIIFWVRSKRSRLLHSDYMNMTPRRPGPTRKHY QPYAPPRDFAAYRSRVKFSRSADAPAYQQGQNQLYNELNLGRREEYDVLDKRRGRDPEMGGKPRR KNPQEGLYNELQKDKMAEAYSEIGMKGERRRGKGHDGLYQGLSTATKDTYDALHMQALPPR |
| 860 | EVQLLESGGGLVQPGGSLRLSCAASGFTFSSEGMSWVRQAPGKERELVSAISGSGDHTYYADSVR GRFTISRDNSKNTLYLQMNSLRAEDTAVYYCNALEGGPTTAIQPGGPDYWGQGTQVTVSSLEPKS CDKTHTCPPCPFWVLVVVGGVLACYSLLVTVAFIIFWVTKKKYSSSVHDPNGEYMFMRAVNTAKK SRLTDVTLRVKFSRSADAPAYQQGQNQLYNELNLGRREEYDVLDKRRGRDPEMGGKPRRKNPQEG LYNELQKDKMAEAYSEIGMKGERRRGKGHDGLYQGLSTATKDTYDALHMQALPPR |

F. Polypeptides

Polypeptides, fusion polypeptides, and polypeptide variants are contemplated in particular embodiments. Exemplary polypeptides contemplated herein include but not limited to, antibodies and antigen binding fragments thereof, fusion polypeptides, bispecific antibodies, bispecific T cell engagers (BiTEs), antibody conjugates, chimeric antigen receptors (CARs) and components thereof, and variants and/or fragments thereof, e.g., SEQ ID NOs: 1-873 and 954-979. Polypeptides contemplated herein also include those encoded by polynucleotide sequences set forth in any one of SEQ ID NOs: 874-953.

Polypeptide," "polypeptide," "peptide," and "protein" are used interchangeably, unless specified to the contrary, and according to conventional meaning, i.e., as a sequence of amino acids. In particular embodiments, a "polypeptide" is a fusion polypeptide or polypeptide variant. Polypeptides can be prepared using any of a variety of well-known recombinant and/or synthetic techniques. Polypeptides are not limited to a specific length, e.g., they may comprise a full-length protein sequence, a fragment of a full-length protein, or a fusion protein, and may include post-translational modifications, e.g., glycosylations, acetylations, phosphorylations and the like, as well as other modifications known in the art, both naturally occurring and non-naturally occurring.

An "isolated peptide," "isolated protein" or an "isolated polypeptide" as used herein, refers to isolation, separation, and/or purification of a polypeptide molecule from a cellular environment, and from association with other components of the cell, i.e., it is not significantly associated with in vivo substances.

Polypeptides include "polypeptide variants." In particular embodiments, a polypeptide variant is referred to as a "modified polypeptide." Polypeptide variants may differ from a naturally occurring polypeptide in one or more amino acid substitutions, deletions, additions and/or insertions. For example, in particular embodiments, it may be desirable to modulate one or more biological activities of a chimeric antigen receptor by introducing one or more amino acid substitutions, deletions, additions and/or insertions into the polypeptide. Such variants may be naturally occurring or may be synthetically generated. In particular embodiments, polypeptides include polypeptide variants having at least about 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 86%, 97%, 98%, or 99% amino acid identity to any reference sequence contemplated herein, typically where the variant maintains at least one biological activity of the reference sequence.

Polypeptides variants include "polypeptide fragments." Illustrative examples of polypeptide fragments include but are not limited to binding domains, hinges, transmembrane domains, intracellular domains, and the like. In particular embodiment, the polypeptide fragment is a biologically active polypeptide fragment. As used herein, the term "biologically active polypeptide fragment" refers to a polypeptide fragment that retains at least 100%, at least 95%, at least 90%, at least 85%, at least 80%, at least 75%, at least 70%, at least 65%, at least 60%, at least 55%, or at least 50% of the naturally occurring polypeptide activity. In certain embodiments, a polypeptide fragment comprises an amino acid sequence at least 5 to about 500 amino acids long. It will be appreciated that in certain embodiments, fragments are at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85, 90, 95, 100, 110, 150, 200, 250, 300, 350, 400, 450, or 500 or more amino acids long. In particular embodiments, a polypeptide fragment comprises an antibody or antigen binding fragment thereof that binds BCMA.

In particular embodiments, a polypeptide comprises one or more amino acid substitutions, deletions, truncations, or insertions using methods that are well known in the art. See, for example, Kunkel (Proc. Natl. Acad. Sci. USA. 82:488-492. (1985)), Kunkel et al., (Methods in Enzymol, 154:367-382. (1987)), U.S. Pat. No. 4,873,192, Watson, J. D. et al., (Molecular Biology of the Gene, Fourth Edition, Benjamin/Cummings, Menlo Park, Calif. (1987)) and the references cited therein. Guidance as to appropriate amino acid substitutions that do not affect biological activity of the protein of interest may be found in the model of Dayhoff et al., Atlas of Protein Sequence and Structure (Natl. Biomed. Res. Found., Washington, D.C. (1978)).

In certain embodiments, a polypeptide variant comprises one or more conservative substitutions. A "conservative substitution" is one in which an amino acid is substituted for another amino acid that has similar properties. Guidance in determining which amino acid residues can be substituted, inserted, or deleted can be found using computer programs well known in the art, such as DNASTAR, DNA Strider, Geneious, Mac Vector, or Vector NTI software. In particular embodiments, amino acid changes in the polypeptide variants contemplated herein comprise one or more conservative amino acid substitutions. A conservative amino acid substitution involves substituting an amino acid with an amino acid having a related side chain. Naturally occurring amino acids are generally divided into four families: acidic (aspartate, glutamate), basic (lysine, arginine, histidine), non-polar (alanine, valine, leucine, isoleucine, proline, phenylalanine, methionine, tryptophan), and uncharged polar (glycine, asparagine, glutamine, cysteine, serine, threonine, tyrosine) amino acids. Phenylalanine, tryptophan, and tyrosine are sometimes classified jointly as aromatic amino acids. In particular embodiments, a conservative amino acid substitution refers to substituting amino acids within the same group or family. Those of skill in this art recognize that, in general, single amino acid substitutions in non-essential regions of a polypeptide do not substantially alter biological activity (see, e.g., Watson et al., Molecular Biology of the Gene, 4th Edition, 1987, The Benjamin/Cummings Pub. Co., p. 224).

In particular embodiments, a conservative amino acid substitution refers to substituting amino acids having a similar hydropathic index or score. The importance of the hydropathic amino acid index in conferring interactive biologic function on a protein is generally understood in the art (Kyte and Doolittle, 1982, incorporated herein by reference). Each amino acid has been assigned a hydropathic index on the basis of its hydrophobicity and charge characteristics (Kyte and Doolittle, 1982). These values are: isoleucine (+4.5); valine (+4.2); leucine (+3.8); phenylalanine (+2.8); cysteine/cysteine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5). In particular embodiments, a conservative amino acid substitution refers to substituting amino acids having a similar hydropathic index or score. In particular embodiments, substitution of amino acids whose hydropathic indices are within ±2 is preferred, those within ±1 are particularly preferred, and those within ±0.5 are even more particularly preferred. It is also understood in the art that the substitution of like amino acids can be made effectively on the basis of hydrophilicity.

In particular embodiments, a conservative amino acid substitution refers to substituting amino acids having a similar hydrophilic index or score. As detailed in U.S. Pat. No. 4,554,101, the following hydrophilicity values have been assigned to amino acid residues: arginine (+3.0); lysine (+3.0); aspartate (+3.0±1); glutamate (+3.0±1); serine (+0.3); asparagine (+0.2); glutamine (+0.2); glycine (0); threonine (−0.4); proline (−0.5+1); alanine (−0.5); histidine (−0.5); cysteine (−1.0); methionine (−1.3); valine (−1.5); leucine (−1.8); isoleucine (−1.8); tyrosine (−2.3); phenylalanine (−2.5); tryptophan (−3.4). In particular embodiments, a conservative amino acid substitution refers to substituting amino acids having a similar hydrophilic index or score. In particular embodiments, substitution of amino acids whose hydrophilic indices are substitution of amino acids whose hydrophilicity values are within ±2 is preferred, those within ±1 are particularly preferred, and those within ±0.5 are even more particularly preferred.

In particular embodiments, a conservative amino acid substitution may be based on the relative similarity of the amino acid side-chain substituents, for example, their hydrophobicity, hydrophilicity, charge, size, and the like.

In particular embodiments, a polypeptide comprises an anti-BCMA antibody or antigen binding fragment thereof comprises a heavy chain variable region (VH) comprising a CDRH1, a CDRH2, and a CDRH3 of an antibody or antigen binding fragment thereof set forth in Table 1; a polypeptide linker; and a light chain variable region (VL) comprising a CDRL1, a CDRL2, and a CDRL3 of an antibody or antigen binding fragment thereof set forth in Table 1; and optionally a polypeptide linker and an anti-CD3 antibody.

In particular embodiments, a polypeptide comprises an anti-BCMA antibody or antigen binding fragment thereof comprises in either orientation (e.g., VL-linker-VH or VH-linker-VL): a VH that comprises a CDRH1, a CDRH2, and a CDRH3 comprising the amino acid sequences set forth in SEQ ID NOs: 12, 13, and 14, a polypeptide linker, and a VL that comprises a CDRL1, a CDRL2, and a CDRL3 comprising the amino acid sequences set forth in SEQ ID NOs: 16, 17, and 18; a VH that comprises a CDRH1, a CDRH2, and a CDRH3 comprising the amino acid sequences set forth in SEQ ID NOs: 22, 23, and 24, a polypeptide linker, and a VL that comprises a CDRL1, a CDRL2, and a CDRL3 comprising the amino acid sequences set forth in SEQ ID NOs: 26, 27, and 28; a VH that comprises a CDRH1, a CDRH2, and a CDRH3 comprising the amino acid sequences set forth in SEQ ID NOs: 32, 33, and 34, a polypeptide linker, and a VL that comprises a CDRL1, a CDRL2, and a CDRL3 comprising the amino acid sequences set forth in SEQ ID NOs: 36, 37, and 38; a VH that comprises a CDRH1, a CDRH2, and a CDRH3 comprising the amino acid sequences set forth in SEQ ID NOs: 42, 43, and 44, a polypeptide linker, and a VL that comprises a CDRL1, a CDRL2, and a CDRL3 comprising the amino acid sequences set forth in SEQ ID NOs: 46, 47, and 48; a VH that comprises a CDRH1, a CDRH2, and a CDRH3 comprising the amino acid sequences set forth in SEQ ID NOs: 52, 53, and 54, a polypeptide linker, and a VL that comprises a CDRL1, a CDRL2, and a CDRL3 comprising the amino acid sequences set forth in SEQ ID NOs: 56, 57, and 58; a VH that comprises a CDRH1, a CDRH2, and a CDRH3 comprising the amino acid sequences set forth in SEQ ID NOs: 62, 63, and 64, a polypeptide linker, and a VL that comprises a CDRL1, a CDRL2, and a CDRL3 comprising the amino acid sequences set forth in SEQ ID NOs: 66, 67, and 68; a VH that comprises a CDRH1, a CDRH2, and a CDRH3 comprising the amino acid sequences set forth in SEQ ID NOs: 72, 73, and 74, a polypeptide linker, and a VL that comprises a CDRL1, a CDRL2, and a CDRL3 comprising the amino acid sequences set forth in SEQ ID NOs: 76, 77, and 78; a VH that comprises a CDRH1, a CDRH2, and a CDRH3 comprising the amino acid sequences set forth in SEQ ID NOs: 82, 83, and 84, a polypeptide linker, and a VL that comprises a CDRL1, a CDRL2, and a CDRL3 comprising the amino acid sequences set forth in SEQ ID NOs: 86, 87, and 88; and a VH that comprises a CDRH1, a CDRH2, and a CDRH3 comprising the amino acid sequences set forth in SEQ ID NOs: 92, 93, and 94, a polypeptide linker, and a VL that comprises a CDRL1, a CDRL2, and a CDRL3 comprising the amino acid sequences set forth in SEQ ID NOs: 96, 97, and 98; and optionally a polypeptide linker and an anti-CD3 antibody. In particular embodiments, the polypeptide linker is selected from the group consisting of: $(GGGGS)_n$ wherein n=1, 2, 3, 4 or 5 (SEQ ID NOs: 3, and 976-979); GEGTSTGSGGSGGSGGAD (SEQ ID NO: 9), GSTSGSGKPGSGEGSTKG (SEQ ID NO: 10) and variants thereof comprising an amino acid sequence at least 90% identical thereto.

In particular embodiments, a polypeptide comprises an anti-BCMA antibody or antigen binding fragment thereof comprises in either orientation (e.g., VL-linker-VH or VH-linker-VL): a VH that comprises the amino acid sequence set forth in any one of SEQ ID NOs: 11, 21, 31, 41, 51, 61, 71, 81, and 91 a polypeptide linker, and a corresponding VL that comprises the amino acid sequence set forth in SEQ ID NO: 15, 25, 35, 45, 55, 65, 75, 85, and 95; and optionally a polypeptide linker and an anti-CD3 antibody; wherein the polypeptide linker is selected from the group consisting of: $(GGGGS)_n$ wherein n=1, 2, 3, 4 or 5 (SEQ ID NOs: 3, and 976-979), GEGTSTGSGGSGGSGGAD (SEQ ID NO: 9), GSTSGSGKPGSGEGSTKG (SEQ ID NO: 10) and variants thereof comprising an amino acid sequence 95% identical thereto.

In particular embodiments, a polypeptide comprises an anti-BCMA antibody or antigen binding fragment thereof comprises the amino acid sequence set forth in any one of SEQ ID NOS: 19, 20, 29, 30, 39, 40, 49, 50, 59, 60, 69, 70, 79, 80, 89, 90, 99, and 100 or an amino acid sequence with at least 85%, at least 90%, at least 91%, at least 92%, at least 93%, at least 94%, at least 95%, at least 96%, at least 97%, at least 98%, at least 99% identity thereto; and optionally a polypeptide linker and an anti-CD3 antibody.

In particular embodiments, a polypeptide comprises an anti-BCMA antibody or antigen binding fragment thereof comprises a VHH domain comprising a CDRH1, a CDRH2, and a CDRH3 of an antibody or antigen binding fragment thereof set forth in Table 1; and optionally a polypeptide linker and an anti-CD3 antibody.

In particular embodiments, a polypeptide comprises an anti-BCMA antibody or antigen binding fragment thereof comprises: a VHH domain that comprises a CDRH1, a CDRH2, and a CDRH3 comprising the amino acid sequences set forth in SEQ ID NOs: 102, 103, and 104; a VHH domain that comprises a CDRH1, a CDRH2, and a CDRH3 comprising the amino acid sequences set forth in SEQ ID NOs: 106, 107, and 108; a VHH domain that comprises a CDRH1, a CDRH2, and a CDRH3 comprising the amino acid sequences set forth in SEQ ID NOs: 110, 111, and 112; a VHH domain that comprises a CDRH1, a CDRH2, and a CDRH3 comprising the amino acid sequences set forth in SEQ ID NOs: 114, 115, and 116; a VHH domain that comprises a CDRH1, a CDRH2, and a CDRH3 comprising the amino acid sequences set forth in SEQ ID NOs: 118, 119, and 120; a VHH domain that comprises a CDRH1, a CDRH2, and a CDRH3 comprising the amino acid sequences set forth in SEQ ID NOs: 122, 123, and 124; a VHH domain that comprises a CDRH1, a CDRH2, and a CDRH3 comprising the amino acid sequences set forth in SEQ ID NOS: 126, 127, and 128; a VHH domain that comprises a CDRH1, a CDRH2, and a CDRH3 comprising the amino acid sequences set forth in SEQ ID NOs: 130, 131, and 132; a VHH domain that comprises a CDRH1, a CDRH2, and a CDRH3 comprising the amino acid sequences set forth in SEQ ID NOs: 134, 135, and 136; a VHH domain that comprises a CDRH1, a CDRH2, and a CDRH3 comprising the amino acid sequences set forth in SEQ ID NOs: 138, 139, and 140; or a VHH domain that comprises a CDRH1, a CDRH2, and a CDRH3 comprising the amino acid sequences set forth in SEQ ID NOs: 142, 143, and 144; and optionally a polypeptide linker and an anti-CD3 antibody.

In particular embodiments, a polypeptide comprises an anti-BCMA antibody or antigen binding fragment thereof comprises a VHH that comprises the amino acid sequence set forth in any one of SEQ ID NOs: 101, 105, 109, 113, 117, 121, 125, 129, 133, 137, and 141 or an amino acid sequence with at least 85%, at least 90%, at least 91%, at least 92%, at least 93%, at least 94%, at least 95%, at least 96%, at least 97%, at least 98%, at least 99% identity thereto; and optionally a polypeptide linker and an anti-CD3 antibody.

Polypeptides contemplated in particular embodiments include fusion polypeptides. In particular embodiments, fusion polypeptides and polynucleotides encoding fusion polypeptides are provided. Fusion polypeptides can include one or more polypeptide domains or segments including but not limited to signal peptides, antibodies or antigen binding fragments thereof, polypeptide linkers, spacer domains, transmembrane domains, intracellular signaling domains, and polypeptide cleavage signals. Fusion proteins and polypeptides are typically linked C-terminus to N-terminus, although they can also be linked C-terminus to C-terminus, N-terminus to N-terminus, or N-terminus to C-terminus. Fusion polypeptides and fusion proteins refer to a polypeptide having at least two, three, four, five, six, seven, eight, nine, or ten polypeptide segments.

In particular embodiments, a fusion polypeptide, e.g., CAR, comprises signal peptide set forth in any one of SEQ ID NOs: 861-873 that is subsequently cleaved from the fusion polypeptide. Signal peptides are short 16 to 30 amino acid N-terminal sequences of nascently synthesized polypeptide chains that mediate protein targeting to the membrane of the endoplasmic reticulum (ER). Typically, signal peptides are cleaved cotranslationally by signal peptidase, a heterooligomeric polypeptide complex. In particular embodiments, a polypeptide comprises a signal peptide. In preferred embodiments, a polynucleotide encoding a polypeptide comprises a polynucleotide encoding a signal polypeptide; and the translated polypeptide does not comprise a signal peptide. Exemplary signal peptides are set forth in Table 5.

TABLE 5

Exemplary Signal Peptides

| SEQ ID NO | AMINO ACID SEQUENCE |
|---|---|
| 861 | MALPVTALLLPLALLLHAARP |
| 862 | METDTLLLWVLLLWVPGSTG |
| 863 | MDMRVPAQLLGLLLLWLRGARC |
| 864 | MPLLLLLPLLWAGALA |
| 865 | MDAMKRGLCCVLLLCGAVFVSPS |
| 866 | MLLLLLLLGLRLQLSLG |
| 867 | MWLQSLLLLGTVACSIS |
| 868 | MGVKVLFALICIAVAEA |
| 869 | MLLLVTSLLLCELPHPAFLLIP |
| 870 | MSRSVALAVLALLSLSGLEA |
| 871 | MGHTRRQGTSPSKCPYLNFFQLLVLAGLSHFCSG |
| 872 | MWWRLWWLLLLLLLLWPMVWA |
| 873 | MLLLLLLLLLALALA |

In particular embodiments, a polypeptide comprises a signal peptide set forth in any one of SEQ ID NOs: 861-973 and a chimeric antigen receptor comprising an amino acid sequence set forth in any one of SEQ ID NOs: 165-860.

In particular embodiments, a polypeptide comprises a signal peptide set forth in any one of SEQ ID NOs: 861-973 and a chimeric antigen receptor encoded by a polynucleotide sequence set forth in any one of SEQ ID NOs: 904-944.

Fusion polypeptides may optionally comprise a polypeptide linker contemplated elsewhere herein that can be used to link one or more polypeptides or domains within a polypeptide. Exemplary linkers are set forth in SEQ ID NOs: 2-10.

In particular embodiments, two or more polypeptides can be expressed as a fusion polypeptide that comprises one or more polypeptide cleavage signals disposed between the two or more polypeptides.

Exemplary polypeptide cleavage signals include, but are not limited to, protease cleavage sites, nuclease cleavage sites and ribosomal skipping polypeptide or self-cleaving viral polypeptides (see, e.g., in Ryan et al., 1997. J. Gener. Virol. 78, 699-722; deFelipe and Ryan, 2004. Traffic, 5 (8); 616-26; and Scymczak et al., (2004) Nature Biotech. 5, 589-594).

Exemplary protease cleavage sites include, but are not limited to the cleavage sites of potyvirus NIa proteases (e.g, tobacco etch virus protease), poty virus HC proteases, potyvirus PI (P35) proteases, byovirus NIa proteases, byovirus RNA-2-encoded proteases, aphthovirus L proteases, enterovirus 2A proteases, rhinovirus 2 A proteases, picoma 3C proteases, comovirus 24K proteases, nepovirus 24K proteases, RTSV (rice tungro spherical virus) 3C-like protease, PYVF (parsnip yellow fleck virus) 3C-like protease, heparin, thrombin, factor Xa and enterokinase.

Illustrative examples of ribosomal skipping polypeptides include but are not limited to: a viral 2A peptide or sequence (Donnelly et al., 2001. J. Gen. Virol. 82:1027-1041). In a particular embodiment, the viral 2A peptide is an aphthovirus 2A peptide, a potyvirus 2A peptide, or a cardiovirus 2A peptide.

In one embodiment, the viral 2A peptide is selected from the group consisting of: a foot-and-mouth disease virus (FMDV) 2A peptide, an equine rhinitis A virus (ERAV) 2A peptide, a Thosea asigna virus (TaV) 2A peptide, a porcine teschovirus-1 (PTV-1) 2A peptide, a Theilovirus 2A peptide, and an encephalomyocarditis virus 2A peptide.

Illustrative examples of viral 2A sequences include, but are not limited to: GSGATNFSLLKQAGDVEENPGP (SEQ ID NO: 956); ATNFSLLKQAGDVEENPGP (SEQ ID NO: 957); LLKQAGDVEENPGP (SEQ ID NO: 958); GSGEGRGSLLTCGDVEENPGP (SEQ ID NO: 959); EGRGSLLTCGDVEENPGP (SEQ ID NO: 960); LLTCGDVEENPGP (SEQ ID NO: 961); GSGQCTNYALLKLAGDVESNPGP (SEQ ID NO: 962); QCTNYALLKLAGDVESNPGP (SEQ ID NO: 963); LLKLAGDVESNPGP (SEQ ID NO: 964); GSGVKQTLNFDLLKLAGDVESNPGP (SEQ ID NO: 965); VKQTLNFDLLKLAGDVESNPGP (SEQ ID NO: 966); LLNFDLLKLAGDVESNPGP (SEQ ID NO: 967); TLNFDLLKLAGDVESNPGP (SEQ ID NO: 968); NFDLLKLAGDVESNPGP (SEQ ID NO: 969); QLLNFDLLKLAGDVESNPGP (SEQ ID NO: 970); APVKQTLNFDLLKLAGDVESNPGP (SEQ ID NO: 971); VTELLYRMKRAETYCPRPLLAIHPTEARHKQKIVAPVKQT (SEQ ID NO: 972); LNFDLLKLAGDVESNPGP (SEQ ID NO: 973); LLAIHPTEARHKQKIVAPVKQTLNFDLLKLAGDVESNPGP (SEQ ID NO: 974); and EARHKQKIVAPVKQTLNFDLLKLAGDVESNPGP (SEQ ID NO: 975).

G. Polynucleotides

Polynucleotides comprising or encoding antibodies and antigen binding fragments thereof, bispecific antibodies, BiTEs, antibody conjugates, chimeric antigen receptors, vectors, promoters, enhancers, Kozak sequences, polyadenylation signals, untranslated regions, and posttranscriptional response elements as well as other polynucleotides are contemplated in various embodiments.

As used herein, the terms "polynucleotide" or "nucleic acid" refer to deoxyribonucleic acid (DNA), ribonucleic acid (RNA) and DNA/RNA hybrids. Polynucleotides may be single-stranded or double-stranded and either recombinant, synthetic, or isolated. Polynucleotides include but are not limited to: pre-messenger RNA (pre-mRNA), messenger RNA (mRNA), RNA, circular RNA (circRNA), synthetic RNA, short interfering RNA (siRNA), short hairpin RNA (shRNA), microRNA (miRNA), ribozymes, genomic RNA (gRNA), viral genomic RNA, plus strand RNA (RNA (+)), minus strand RNA (RNA (−)), tracrRNA, crRNA, single guide RNA (sgRNA), Doggybone DNA (dbDNA), linear DNA, circular DNA, PCR amplified DNA, complementary DNA (cDNA), synthetic DNA, or recombinant DNA. Polynucleotides refer to a polymeric form of nucleotides of at least 5, at least 10, at least 15, at least 20, at least 25, at least 30, at least 40, at least 50, at least 100, at least 200, at least 300, at least 400, at least 500, at least 1000, at least 5000, at least 10000, or at least 15000 or more nucleotides in length, either ribonucleotides or deoxyribonucleotides or a modified form of either type of nucleotide, as well as all intermediate lengths. It will be readily understood that "intermediate lengths," in this context, means any length between the quoted values, such as 6, 7, 8, 9, etc., 101, 102, 103, etc., 151, 152, 153, etc., 201, 202, 203, etc.

As used herein, "isolated polynucleotide" refers to a polynucleotide that has been isolated from or purified from the sequences which flank it in a naturally-occurring state. In particular embodiments, an isolated polynucleotide is a synthetic polynucleotide, a semi-synthetic polynucleotide, or a polynucleotide obtained or derived from a recombinant source, or other polynucleotide that does not exist in nature and that has been made by the hand of man.

In particular embodiments, polynucleotides contemplated herein are polynucleotide variants. As used herein, the terms "polynucleotide variant" and "variant" and the like refer to polynucleotides displaying substantial sequence identity with a reference polynucleotide sequence or polynucleotides that hybridize with a reference sequence under stringent conditions that are defined hereinafter. These terms also encompass polynucleotides that are distinguished from a reference polynucleotide by the addition, deletion, substitution, or modification of one or more nucleotides. Accordingly, the terms "polynucleotide variant" and "variant" include polynucleotides in which one or more nucleotides have been added or deleted, or modified, or replaced with different nucleotides. In this regard, it is well understood in the art that certain alterations inclusive of mutations, additions, deletions and substitutions can be made to a reference polynucleotide whereby the altered polynucleotide retains the biological function or activity of the reference polynucleotide or wherein the function or activity of the altered polynucleotide is modulated. In particular embodiments, polynucleotides or polynucleotide variants have at least or about 50%, 55%, 60%, 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to a reference sequence.

In particular embodiments, a polynucleotide variant includes a polynucleotide fragment that encodes biologically active polypeptide fragments or variants. As used herein, the term "polynucleotide fragment" refers to a polynucleotide fragment at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85, 90, 95, 100, 110, 150, 200, 250, 300, 350, 400, 450, 500, 550, 600, 650, 700, 750, 800, 850, 900, 950, 1000, 1100, 1200, 1300, 1400, 1500, 1600, 1700 or more nucleotides in length that encodes a polypeptide variant that retains at least 100%, at least 90%, at least 80%, at least 70%, at least 60%, at least 50%, at least 40%, at least 30%, at least 20%, at least 10%, or at least 5% of the naturally occurring polypeptide activity. Polynucleotide fragments refer to a polynucleotide that encodes a polypeptide that has an amino-terminal deletion, a carboxyl-terminal deletion, and/or an internal deletion or substitution of one or more amino acids of a naturally occurring or recombinantly-produced polypeptide.

As used herein, the phrases "sequence identity" or, for example, comprising a "sequence 50% identical to," refer to the extent that sequences are identical on a nucleotide-by-nucleotide basis or an amino acid-by-amino acid basis over a window of comparison. A "percentage of sequence identity" may be calculated by comparing two optimally aligned sequences over the window of comparison, determining the number of positions at which the identical nucleic acid base (e.g., A, T, C, G, I) or the identical amino acid residue (e.g., Ala, Pro, Ser, Thr, Gly, Val, Leu, Ile, Phe, Tyr, Trp, Lys, Arg, His, Asp, Glu, Asn, Gln, Cys and Met) occurs in both sequences to yield the number of matched positions, dividing the number of matched positions by the total number of positions in the window of comparison (i.e., the window size), and multiplying the result by 100 to yield the percentage of sequence identity. In particular embodiments, polynucleotides and polypeptides comprise at least about 50%, 55%, 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 86%, 97%, 98%, or 99% sequence identity to any of the reference sequences described herein, e.g., SEQ ID NOs: 1-979.

Illustrative examples of polynucleotides include, but are not limited to, polynucleotide sequences set forth in any one of SEQ ID NOs: 874-953 and polynucleotides encoding polypeptides set forth in SEQ ID NOs: 1-873 and 954-979.

In various embodiments, a polynucleotide encodes a polypeptide comprising an amino acid sequence set forth in any one of SEQ ID NOs: 1-873 and 954-979.

In various embodiments, a polynucleotide encodes an antigen or antigen binding fragment thereof comprising an amino acid sequence set forth in any one of SEQ ID NOs: 11-144. In particular embodiments, a polynucleotide encoding an antigen or antigen binding fragment thereof comprises a polynucleotide sequence set forth in any one of SEQ ID NOs: 874-893.

Table 6 sets forth the SEQ ID NOs. and associated nucleic acid sequences encoding anti-BCMA antibodies or antigen binding fragments thereof and the corresponding amino acid SEQ ID NO (AA SEQ ID NO.) encoded by the nucleic acid sequence.

TABLE 6

| SEQ ID NO. | AA SEQ ID NO. | NUCLEIC ACID SEQUENCE |
|---|---|---|
| 874 | 20 | GAGATCGTGCTGACACAGTCTCCCGCCACACTGTCACTGTCTCCAGGC<br>GAAAGAGCCACACTGAGCTGTAGAGCCAGCCAGAGCGTGTCCTCTTAC<br>CTGGCCTGGTATCAGCAGAAGCCTGGACAGGCTCCCCGGCTGCTGATC<br>TACGATGCCAGCAATAGAGCCACAGGCATCCCCGCCAGATTTTCTGGC<br>AGCGGCTCTGGCACCGATTTCACCCTGACCATAAGCAGCCTGGAACCT<br>GAGGACTTCGCCGTGTACTACTGCCAGCAGAGAGTGGTGTACCCCATC<br>ACCTTTGGCGGAGGCACCAAGGTGGAAATCAAAGGCGGCGGAGGAAGC<br>GGAGGCGGAGGATCTGGTGGTGGTGGATCTGGCGGAGGTGGCAGCCAG<br>ATCACACTGAAAGAGTCTGGCCCCACACTGGTCAAGCCCACACAGACC<br>CTGACACTGACCTGCACCTTCAGCGGCTTTAGCCTGAGCACATCTGGC<br>GTCGGCGTTGGCTGGATTAGACAGCCTCCTGGAAAGGCCCTGGAATGG<br>CTGGCCCTGATCTACTGGAACGACGAGAAGAGATACAGCCCCAGCCTG<br>AAGTCCCGGCTGACCATCACCAAGGACACCAGCAAGAACCAGGTGGTG<br>CTGACCATGACAAACATGGACCCCGTGGACACCGCCGTGTATTATTGC<br>GCCAGAGATGAGTACGGCGGCTTCGACATTTGGGGCCAGGGCACAATG<br>GTCACCGTGTCTAGT |
| 875 | 30 | GAGATCGTGCTGACCCAGTCCCCTGCTACCCTGAGCCTGTCTCCAGGC<br>GAGCGGGCCACACTGAGCTGTAGAGCTTCTCAGAGCGTGTCCAGCTAC<br>CTGGCCTGGTATCAGCAGAAACCTGGCCAGGCCCCTAGACTGCTGATC<br>TACGACGCCAGCAACCGGGCCACCGGCATCCCCGCCAGATTCAGCGGA<br>TCTGGCAGCGGCACAGATTTTACCCTCACCATCAGCAGCCTGGAACCT<br>GAGGACTTCGCCGTCTACTACTGCCAGCAAAGATTCGACTACCCCATC<br>ACCTTCGGCGGCGGAACAAAGGTGGAAATTAAGGGTGGTGGGGGCAGC<br>GGTGGAGGTGGGAGCGGAGGCGGGGGTAGCGGAGGCGGGGGTAGCCAA<br>ATCACACTGAAAGAGAGCGGCCCTACACTCGTGAAACCTACCCAGACC<br>CTGACACTGACATGTACCTTCAGCGGCTTCTCCCTGAGCACCTCTGGC<br>GTCGGCGTTGGATGGATCAGACAGCCTCCAGGCAAGGCCCTGGAATGG<br>CTGGCTCTGATCTATTGGAACGACGACAAGCGGTACAGCCCCAGCCTG<br>AAGTCTAGACTGACCATCACAAAGGACACCAGCAAGAACCAGGTGGTG<br>CTGACCATGACAAATATGGACCCCGTGGACACCGCCGTGTACTACTGC<br>GCCAGAGATGAGTACGGCGGATTTGATATCTGGGGCCAGGGCACCATG<br>GTGACCGTGTCCAGC |
| 876 | 39 | CAAGTGCAGCTCGTGGAAAGCGGCGGCGGAGTGGTGCAGCCCGGCCGG<br>AGCCTGAGACTGTCCTGCGCCGCTTCTGGATTTACCTTCAGCAGCTAC<br>GGCATGCACTGGGTCAGACAGGCCCCTGGCAAAGGCCTGGAGTGGGTG<br>GCCGTTATCAGCTACGAGGGCAGCAACAAGTATTACGCCGACAGCGTG<br>AAGGGCCGCTTCACAATCTCTAGAGATAATAGCAAGAACACCCTGTAC<br>CTGCAGATGAACAGCCTGCGGGCCGAAGATACCGCCGTGTACTACTGT |

TABLE 6-continued

| SEQ ID NO. | AA SEQ ID NO. | NUCLEIC ACID SEQUENCE |
|---|---|---|
| | | GCTAGAGAGCTGGGCGACGGCATGGACGTGTGGGGACAGGGCACAACC<br>GTGACCGTGTCCTCTGGTGGTGGGGGCAGCGGTGGAGGTGGGAGCGGA<br>GGCGGGGGTAGCGGAGGCGGGGGTAGCGAGATCGTGCTGACCCAGTCC<br>CCTGCTACACTGAGCCTGTCTCCAGGCGAGCGGGCCACACTGAGCTGT<br>AGAGCTTCTCAGAGCGTGTCCAGCTATCTGGCCTGGTTCCAGCAGAAA<br>CCTGGCCAGGCCCCTAGACTGCTGATCTACGACGCCAGCAACCGGGCC<br>ACCGGCATCCCCGCCAGATTCAGCGGCTCTGGCAGCGGCACCGACTTC<br>ACCCTCACCATCAGCAGCCTGGAACCCGAGGATTTTGCCGTCTACTAC<br>TGCCAGCAAAGAGTGGACCTGTGGACCTTCGGCGGAGGAACAAAGGTG<br>GAAATCAAG |
| 877 | 45 | GACATCCAGATGACCCAGAGCCCTTCGACCCTATCCGCTTCCGTGGGT<br>GACCGTGTGACCATCACCTGTCGCGCGTCGCAGAGCATCTCCTCCTGG<br>CTCGCGTGGTACCAACAGAAGCCTGGCAAGGCCCCCAAGCTGCTGATT<br>TACGACGCCAGTTCCCTGGAGTCTGGCGTGCCATCCCGCTTCTCCGGC<br>AGCGGCAGCGGTACCGAGTTCACCCTGACGATCAGCTCCCTGCAGCCG<br>GATGACTTTGCTACCTACTACTGTCAGCAGGTCTCCTCCCTCCCCCCC<br>ACCTTCGGTGGCGGTACCAAGGTGGAGATCAAGGGCGGCGGCGGCTCT<br>GGTGGCGGAGGTTCTGGCGGGGGAGGTTCGGGGGGGGGAGGCTCCGAG<br>GTGCAACTGGTAGAGAGCGGCGGGGGACTGGTAAAACCCGGCGGCTCC<br>CTGCGGCTGTCATGCGCTGCTAGCGGCTTCACGTTCAGCGATTACTAC<br>ATGAGTTGGATCCGCCAGGCCCCCGGGAAGGGTTTGGAGTGGGTCTCG<br>TATATCTCTTCCAGCGGATCTACCATTTACTATGCGGACAGCGTGAAG<br>GGGCGCTTCACCATATCTCGGGACAACGCCAAGAACTCCCTGTACCTG<br>CAGATGAATTCCCTGCGTGCCGAGGACACGGCCGTGTATTACTGTGCC<br>CGCGACCAGGGCAACTACGGCGTCGACGTGTGGGGCCAGGGTACAACC<br>GTCACCGTGTCCAGT |
| 878 | 59 | CAAGTGCAGCTGGTCGAGAGCGGAGGAGGCCTGGTTAAGCCCGGCGGA<br>TCTCTCAGACTGAGCTGCGCCGCTAGCGGCTTTACATTCAGCGACTAC<br>TACATGAGCTGGATCCGGCAGGCCCCTGGCAAGGGCCTGGAATGGGTG<br>TCCTACATCAGCTCCTCCGGCAGCACCATCTACTACGCCGACAGCGTG<br>AAAGGCAGATTCACAATCTCTAGAGATAATGCCAAGAACAGCCTGTAC<br>CTGCAGATGAACAGCCTGCGGGCCGAGGACACCGCCGTGTACTATTGT<br>GCTAGAGATCAGGGCAACTACGGCGTGGACGTGTGGGGCCAGGGCACC<br>ACCGTGACCGTGTCTAGCGGTGGTGGGGGCAGCGGTGGAGGTGGGAGC<br>GGAGGCGGGGGTAGCGGAGGCGGGGGTAGCGATATCCAGATGACCCAG<br>TCCCCATCTACACTGAGCGCCTCTGTGGGCGACCGGGTGACCATTACA<br>TGTAGAGCCAGCCAGAGCATCAGCAGCTGGCTGGCTTGGTATCAGCAG<br>AAACCTGGCAAGGCCCCTAAGCTGCTGATCTACGAGGCCAGCAGCCTG<br>GAAAGCGGCGTCCCCAGCAGATTCAGCGGCAGCGGCTCTGGAACAGAG<br>TTCACCCTGACCATCTCCTCCCTGCAGCCTGACGACTTCGCCACCTAC<br>TACTGCCAGCAATCTGATAGCCACCCCATCACCTTTGGCGGAGGCACC<br>AAGGTGGAAATCAAG |
| 879 | 70 | GATATCCAGATGACCCAGTCCCCATCTACACTGAGCGCCTCTGTGGGC<br>GACCGGGTGACAATTACCTGTAGAGCTAGCCAGAGCATCTCCTCCTGG<br>CTGGCTTGGTACCAGCAAAAACCTGGCAAGGCCCCTAAGCTGCTGATC<br>TACGAGGCCAGCAGCCTGGAAAGCGGCGTCCCCTCTAGATTCAGCGGC<br>AGCGGCTCTGGAACCGAGTTCACCCTGACAATCAGCAGCCTGCAGCCT<br>GACGACTTCGCCACCTATTACTGCCAGCAGGCCAACAGCCACCCCATC<br>ACCTTTGGCGGAGGCACCAAGGTGGAAATCAAGGGTGGTGGGGGCAGC<br>GGTGGAGGTGGGAGCGGAGGCGGGGGTAGCGGAGGCGGGGGTAGCGAG<br>GTGCAGCTGGTGGAAAGCGGCGGAGGACTCGTTAAGCCCGGCGGCAGC<br>CTGAGACTGAGCTGCGCCGCTAGCGGATTTACCTTCAGCGACTACTAC<br>ATGAGCTGGATCCGGCAGGCCCCTGGCAAGGGCCTGGAATGGGTCAGC<br>TACATCAGCTCCTCTGGCTCTACAATCTACTACGCCGACAGCGTGAAA<br>GGCAGATTCACCATCTCTAGAGATAATGCCAAGAACAGCCTGTACCTG<br>CAAATGAACAGCCTGCGGGCCGAGGACACCGCCGTGTACTATTGTGCT<br>AGAGATCAGGGCAACTACGGCGTGGACGTGTGGGGCCAGGGCACCACC<br>GTGACAGTGTCCTCC |
| 880 | 80 | GACATCCAGATGACCCAGAGCCCTAGCTCCCTGAGCGCCAGCGTGGGC<br>GATAGAGTGACCATTACCTGTAGAGCCTCTCAGAGCATCTCCTCCTAC<br>CTGAACTGGTATCAGCAGAAACCCGGCAAGGCCCCTAAGCTGCTGATC<br>TACGCCGCTAGCAGCCTGCAGTCTGGCGTCCCCAGCCGGTTCAGCGGC<br>AGCGGATCTGGCACCGACTTCACCCTGACAATCAGCAGCCTGCAACCT<br>GAGGACTTTGCTACATACTACTGCCAGCAGGCCCACAGCTCTCCAATC<br>ACCTTCGGCGGCGGAACAAAGGTGGAAATCAAGGGTGGTGGGGGCAGC<br>GGTGGAGGTGGGAGCGGAGGCGGGGGTAGCGGAGGCGGGGGTAGCGAG<br>GTGCAGCTGCTGGAAAGCGGAGGCGGACTCGTTCAACCTGGCGGCAGC<br>CTGAGACTGAGCTGCGCCGCTTCTGGATTTACCTTCAGCAACTACGCC<br>ATGAGCTGGGTGCGGCAGGCCCCTGGCAAAGGCCTGGAATGGGTCTCC<br>GCCATCAGCGGCTCTGGCGGCTCCACCTACTACGCCGACAGCGTGAAG<br>GGCAGATTCACCATCTCTAGAGATAATAGCAAGAACACCCTGTACCTG |

TABLE 6-continued

| SEQ ID NO. | AA SEQ ID NO. | NUCLEIC ACID SEQUENCE |
|---|---|---|
| | | CAGATGAACAGCCTGCGGGCCGAGGACACCGCCGTGTACTATTGTGCT AGACCCGGAGATGGCTACTACGAGGGCGTGTACTTCGACTACTGGGGC CAGGGCACACTGGTGACAGTGTCCAGC |
| 881 | 90 | GATATTCAGATGACCCAGAGCCCATCTAGCCTGAGCGCCAGCGTGGGC GATAGAGTGACCATCACCTGTCAGGCCTCTCAGGACATCGCTAATTAC CTGAACTGGTATCAGCAGAAACCCGGCAAGGCCCCTAAGCTGCTGATC TACGACGCCTCCAACCTGGAAACCGGCGTGCCCAGCCGGTTCAGCGGC AGCGGATCTGGCACAGACTTCACCTTTACCATCAGCTCCCTCCAGCCT GAGGACATCGCCACATACTACTGCCAGCAACACTTCAACCTGCCTCTG ACCTTCGGCGGCGGAACAAAGGTCGAGATCAAGGGTGGTGGGGGCAGC GGTGGAGGTGGGAGCGGAGGCGGGGGTAGCGGAGGCGGGGGTAGCCAA ATCACCCTGAAAGAGAGCGGACCTACACTGGTCAAGCCTACCCAGACA CTGACCCTCACATGTACATTCAGCGGCTTTAGCCTGAGCACCTCCGGC GTGGGAGTGGGCTGGATCAGACAGCCCCCCGGCAAGGCCCTGGAATGG CTGGCTCTGATCTATTGGAATGACGAGAAGCGGTACAGCCCTAGCCTG AAATCTAGACTGACAATCACCAAGGACACCAGCAAGAACCAGGTGGTG CTGACCATGACCAACATGGATCCTGTGGATACCGCCGTGTACTACTGC GCCAGAGAAGGCTCTCACGACTACAAGAGCTCCAACTGGTTCGACCCA TGGGGCCAGGGCACCCTGGTTACAGTGTCTAGC |
| 882 | 100 | GATATCGTGATGACCCAATCTCCACTGAGCCTGCCTGTGACACCTGGC GAGCCTGCTTCTATCAGCTGTAGAAGCAGCCAGTCCCTGCTGCACAGC AACGGCTACAACTACCTGGACTGGTATCTGCAGAAACCCGGCCAGAGC CCCCAGCTGCTGATCTACCTCGGCTCTAATCGGGCCAGCGGAGTGCCT GATAGATTCAGCGGAAGCGGCTCCGGCACCGACTTCACCCTGAAGATC AGCAGAGTGGAAGCCGAGGACGTGGGCGTCTACTACTGCATGCAGGCC CTGGGCCTGATTACATTTGGCGGCGGAACCAAGGTGGAAATCAAGGGT GGTGGGGGCAGCGGTGGAGGTGGGAGCGGAGGCGGGGGTAGCGGAGGC GGGGGTAGCGAAGTGCAGCTGGTTGAGAGCGGCGGCGGACTGGTGAAG CCCGGAGGCAGCCTCAGACTGAGCTGTGCTGCTTCTGGCTTTACCTTC AGCTCTTATAGCATGAACTGGGTGCGGCAGGCCCCTGGCAAGGGCCTG GAATGGGTCAGCTCCATCAGCTCTTCTAGCAGCTACATCTACTACGCC GACAGCGTGAAGGGCAGATTCACCATCAGCAGAGATAACGCCAAGAAC AGCCTGTACCTGCAGATGAATAGCCTGCGGGCCGAGGACACCGCCGTG TACTACTGCGCCAGAGCCGGCGACACCTACAGCGCCGCCGATTACTAC TACATGGACGTGTGGGGCAAAGGAACAACCGTGACAGTGTCCTCC |
| 883 | 101 | GAAGTGCAACTGCTGGAAAGCGGCGGAGGCCTGGTCCAGCCCGGCGGC TCTCTGCGGCTCAGCTGCGCCGCTTCTGGATTTACCTTCGGCAGCGAG GCTATGAGCTGGGTGCGGCAGGCCCCTGGAAAAGAGAGAGAGCTGGTG TCCGCCATCAGCGGCAGCGGCGAGGTGACCTACTACGCCGACAGCGTG AAGGGCAGATTCACCATCTCTAGAGATAATAGCAAGAACACCCTGTAC CTGCAGATGAACAGCCTGAGAGCCGAGGACACCGCCGTGTACTATTGT CAGAGACTGGTGGAAGCCAAGCGGCACTGGGGCCAGGGCACACAGGTT ACAGTGTCCAGC |
| 884 | 105 | GAAGTGCAACTGCTGGAATCTGGCGGAGGACTGGTGCAGCCCGGCGGC AGCCTGCGGCTGAGCTGTGCTGCTTCTGGCTTTACCTTCGAGTCTGAG GCCATGAGCTGGTATAGACAGGCCCCTGGCAAGGAAAGAGAGCTGGTC AGCGTGATCACCAGCGAGGGCTCCACCTACTACGCCGACAGCGTGAAA GGCAGATTCACAATCAGCCGGGACAATAGCAAGAACACCCTGTACCTG CAGATGAACAGCCTGCGCGCCGAAGATACAGCCGTGTACTACTGCGCC CACATCGAGTGGGAGACAAGACTCAACTGGGGCCAGGGCACCCAGGTG ACCGTGTCCAGC |
| 885 | 109 | GAGGTGCAGCTGCTGGAAAGCGGAGGGGGCCTGGTCCAACCCGGCGGG TCTCTTCGCCTAAGCTGTGCCGCTTCTGGCTTCACCTTCGACGAGTAC ACCATGCACTGGTTCAGACAGGCCCCCGGCAAGGAGCGCGAGTTCGTC AGTGCAATCAGCGGAGGCGGTAGCGAGACTTATTACGCGGACTCCGTG AAGGGCCGCTTCACCATTAGCCGCGACAACTCCAAGAACACGCTGTAC CTGCAGATGAATTCGCTGCGCGCCGAAGATACGGCCGTGTACTACTGT GCCGCTGGTGGGGAGGAGGCTGGCGTGGGCTATTGGGGCCAGGGCACC CAGGTCACCGTGTCGTCC |
| 886 | 113 | GAGGTGCAGCTGCTGGAGAGCGGAGGCGGCCTCGTGCAGCCAGGAGGT TCCCTACGACTCTCCTGTGCCGCCAGCGGCTTCACCTTCGAGGACTAC GCCATGAGTTGGTTCCGCCAGGCCCCGGGGAAGGAGCGCGAGGGCGTG AGCGCGATTTCTGGAAAGGGCGGCTCCACCTATTACGCGGACTCCGTG AAGGGTCGCTTTACCATCTCTCGCGACAACTCCAAGAACACGCTGTAC CTGCAGATGAATAGCCTGCGCGCTGAGGACACTGCCGTGTACTACTGT GCTGTCTTGGACGAGGAGGCCGGCGCAGAGGGCGGCTATTGGGGCCAG GGTACCCAGGTCACCGTGTCGTCC |
| 887 | 117 | GAGGTGCAACTGCTGGAAAGCGGCGGTGGACTGGTGCAGCCCGGCGGC AGCCTGAGACTGTCTTGTGCTGCTTCTGGATTTACATTCGACAGATAC GCCATGAGCTGGTTCCGCCAGGCCCCTGGCAAAGAGCGGGAAGGCGTG |

TABLE 6-continued

| SEQ ID NO. | AA SEQ ID NO. | NUCLEIC ACID SEQUENCE |
|---|---|---|
| | | TCCGCCATCTCCACAAGCGGAGATAGCACATACTATGCCGACAGCGTG AAGGGCAGATTCACCATCAGCAGAGATAATAGCAAGAACACCCTGTAC CTGCAGATGAACAGCCTCCGGGCCGAGGACACCGCCGTCTACTACTGC GCCGTGCTGGACGAGGAAGCCGGCGCCGAGGGCGGCTACTGGGGCCAG GGCACCCAGGTGACCGTGTCTAGC |
| 888 | 121 | GAGGTGCAACTGCTGGAAAGCGGCGGAGGACTCGTCCAGCCCGGCGGC AGCCTGCGGCTGAGCTGTGCTGCTTCTGGATTTACCTTCGCCAGCGAC GCCATGAGCTGGTATAGACAGGCCCCTGGCAAAGAGCGGGAACTGGTG TCCGCCATCAGCGGCTCTGGCGGCTCCACCTACTACGCCGATAGCGTG AAGGGCAGATTCACAATCTCTAGAGATAATAGCAAGAACACCCTGTAC CTGCAGATGAACAGCCTGAGAGCCGAGGACACCGCCGTGTACTACTGC GCCGCTCACGACAGCGGCGAGGCCTACCTGGCCTTCGACTACTGGGGC CAGGGCACACAGGTGACCGTGTCTAGC |
| 889 | 125 | GAGGTGCAACTGCTGGAAAGCGGCGGAGGACTCGTCCAGCCCGGCGGC AGCCTGAGGCTGAGCTGTGCTGCTTCTGGCTTTACCTTCGACTCCTAC ACAATGAGCTGGTATAGACAGGCCCCTGGCAAGGAGCGGGAACTGGTG TCCGCCATCAGCGGCCACGGCGACTCTACATACTACGCCGACAGCGTG AAAGGCAGATTCACAATCTCTAGAGATAATAGCAAGAACACCCTGTAC CTGCAGATGAACAGCCTGCGGGCCGAGGACACCGCCGTGTACTACTGC ACCAGAATCAGCATCACCACCGAGTGGCTGGCCGGAGATTACTGGGGC CAGGGCACCCAGGTGACAGTGTCCAGC |
| 890 | 129 | GAGGTGCAGCTGCTGGAAAGCGGAGGAGGCCTGGTCCAACCTGGCGGC AGCCTGCGGCTGAGCTGCGCCGCTTCTGGCTTCACCTTCAGCAGCTAC GCCATGAGCTGGTTCCGGCAGGCCCCTGGCAAGGAAAGAGAGTTCGTG TCTTTTATCAGCGGATCTGGCGACTCCACCTACTACGCTGATAGCGTG AAAGGCAGATTTACCATCTCTAGAGATAATAGCAAGAACACCCTGTAC CTCCAGATGAACAGCCTGCGCGCCGAGGACACAGCCGTGTACTATTGT ACCAGATGGCCTTACGACTTCGAGGAACCAAGCGAGCCCGGCGTGTAC TGGGGCCAGGGCACACAGGTGACAGTGTCCTCC |
| 891 | 133 | GAGGTGCAGCTGCTGGAAAGCGGCGGAGGCCTGGTGCAACCTGGCGGA TCTCTCAGACTGAGCTGTGCTGCTTCTGGCTTCACATTCACCGACTAC GACATGAGCTGGTATAGACAGGCCCCTGGAAAAGAGCGGGAACTGGTC TCCGTGATCCACAGCGGCGGCTCCACCTACTACGCCGATAGCGTGAAG GGCAGATTCACCATCAGCAGAGATAATAGCAAGAACACCCTGTACCTG CAGATGAACAGCCTGCGGGCCGAGGACACCGCCGTGTACTACTGCGCC CCCGGCTACTACAGCGACCTGTCTTTTGATTATTACAACTTCGACTAC TGGGGCCAGGGCACACAGGTGACAGTGTCCAGC |
| 892 | 137 | GAGGTGCAGCTGCTGGAGAGCGGTGGAGGGTTGGTGCAGCCCGGGGGT AGCCTGCGTCTGTCGTGCGCCGCTTCCGGCTTCACGTTCTCTGATTAC GCCATGCACTGGTTCCGGCAGGCCCCCGGTAAGGAGCGCGTGCTGGTG TCGTCTATTGACTCCGGCGGCTCCACTTACTACGCAGACAGTGTCAAG GGCCGTTTCACCATCAGCCGCGACAACAGCAAGAACACGCTGTACCTG CAGATGAACTCCCTTCGAGCAGAGGACACCGCGGTGTACTACTGTAAT GCGGGCTTCAAGGGCGATCACCCCCACCCCAAGGATGCCTTCGACATT TGGGGCCAGGGCACCCAGGTCACCGTGTCGTCC |
| 893 | 141 | GAGGTGCAACTGCTGGAATCCGGCGGAGGCCTGGTGCAGCCCGGCGGC AGCCTCAGACTGAGCTGTGCCGCTTCTGGCTTTACCTTCAGCAGCGAG GGCATGAGCTGGGTGCGGCAGGCCCCTGGCAAGGAAAGAGAGCTGGTC TCCGCCATCAGCGGATCTGGCGACCACACCTACTATGCCGATAGCGTG CGCGGAAGATTCACAATCTCTAGAGATAATAGCAAGAACACCCTGTAC CTGCAGATGAACAGCCTGCGGGCCGAGGACACCGCCGTGTACTACTGC AACGCCCTGGAAGGCGGCCCTACAACAGCTATCCAGCCAGGAGGCCCT GACTACTGGGGCCAGGGCACCCAGGTGACCGTGTCCAGC |

In various embodiments, a polynucleotide encodes a chimeric antigen receptor comprising an anti-BCMA antibody or antigen binding fragment thereof comprising an amino acid sequence set forth in any one of SEQ ID NOs: 11-144. In particular embodiments, a polynucleotide encodes a chimeric antigen receptor comprising an anti-BCMA antibody or antigen binding fragment thereof comprising an amino acid sequence set forth in any one of SEQ ID NOs: 20, 30, 39, 50, 59, 70, 80, 90, 100, 101, 105, 109, 113, 117, 121, 125, 129, 133, 137, and 141; and optionally a polypeptide linker and an anti-CD3 antibody.

In particular embodiments, a polynucleotide encodes a chimeric antigen receptor comprising an amino acid sequence set forth in any one of SEQ ID NOs: 165-860. In particular embodiments, a polynucleotide encodes a chimeric antigen receptor comprising an amino acid sequence set forth in any one of SEQ ID NOs: 189, 237, 261, 333, 357, 429, 477, 525, 573, 597, 621, 645, 669, 693, 717, 741, 765, 789, 813, and 837. In particular embodiments, a polynucleotide encoding a chimeric antigen receptor comprises a polynucleotide sequence set forth in any one of SEQ ID NOs: 905-944.

In particular embodiments, polynucleotides encoding a chimeric antigen receptor may be codon-optimized. As used herein, the term "codon-optimized" refers to substituting codons in a polynucleotide encoding a polypeptide in order to modulate polypeptide expression, stability and/or activity. Factors that influence codon optimization include, but are not limited to one or more of: (i) variation of codon biases between two or more organisms or genes or synthetically constructed bias tables, (ii) variation in the degree of codon bias within an organism, gene, or set of genes, (iii) systematic variation of codons including context, (iv) variation of codons according to their decoding tRNAs, (v) variation of codons according to GC %, either overall or in one position of the triplet, (vi) variation in degree of similarity to a reference sequence for example a naturally occurring sequence, (vii) variation in the codon frequency cutoff, (viii) structural properties of mRNAs transcribed from the DNA sequence, (ix) prior knowledge about the function of the DNA sequences upon which design of the codon substitution set is to be based, (x) systematic variation of codon sets for each amino acid, and/or (xi) isolated removal of spurious translation initiation sites.

A "nucleic acid cassette," "expression cassette" or "nucleic acid expression cassette" refers to polynucleotide sequences sufficient to transcribe an RNA, which is ultimately translated to a polypeptide. In particular embodiments, a nucleic acid cassette comprises a polynucleotide-of-interest, a polynucleotide that encodes a polypeptide, e.g., a CAR. Nucleic acid expression cassettes contemplated in particular embodiments comprise one or more expression control sequences, e.g., a promoter, enhancer, poly(A) sequence, and one or more polynucleotide(s)-of-interest. In particular embodiments, a vector contemplated herein comprises one or more nucleic acid cassettes. In particular embodiments, a nucleic acid cassette is oriented in a vector to enable transcription of a polynucleotide-of-interest.

In particular embodiments, a polynucleotide encoding a polypeptide may be combined with other polynucleotide sequences, such as expression control sequences, promoters and/or enhancers, untranslated regions (UTRs), polynucleotides encoding signal peptides, Kozak sequences, polyadenylation signals, restriction enzyme sites, multiple cloning sites, internal ribosomal entry sites (IRES), recombinase recognition sites, termination codons, transcriptional termination signals, and polynucleotides encoding self-cleaving polypeptides or epitope tags, as disclosed elsewhere herein or as known in the art.

Polynucleotides can be prepared, manipulated, expressed and/or delivered using any of a variety of well-established techniques known and available in the art. In order to express a desired polypeptide, a nucleotide sequence encoding the polypeptide, can be inserted into an appropriate vector.

In particular embodiments, a polynucleotide is inserted into a non-viral vector. Illustrative examples of non-viral vectors include but are not limited to autonomously replicating sequences; plasmids; phagemids; cosmids; artificial chromosomes such as yeast artificial chromosomes (YAC), bacterial artificial chromosomes (BAC), or P1-derived artificial chromosomes (PAC); bacteriophages such as lambda phage or M13 phage; and transposable elements including but not limited to piggyBac, Sleeping Beauty, Mosl, Tcl/mariner, Tol2, mini-Tol2, Tc3, MuA, Himar I, Frog Prince, and derivatives thereof.

In particular embodiments, a polynucleotide is inserted into a viral vector. Illustrative examples of viral vectors include but are not limited to Adenoviral (Ad) vectors, adeno-associated virus (AAV) vectors, rhabdovirus (e.g., lyssavirus, vesiculovirus) vectors, paramyxovirus (e.g., henipavirus, morbillivirus, respirovirus, rubelavirus) vectors, herpes simplex virus (e.g., HSV-1, HSV-2) vectors, vaccinia virus vectors, and retroviral vectors, preferably lentiviral vectors (LVV).

In particular embodiments, a vector comprises a polynucleotide comprising or encoding one or more exogenous, endogenous, or heterologous expression control sequences operably linked to a polynucleotide encoding one or more polynucleotides and/or polypeptides contemplated herein.

"Expression control sequences," "control elements," or "regulatory sequences" contemplated in particular embodiments include but not limited to promoters, enhancers, translation initiation signals (Shine Dalgamo sequence or Kozak sequence), introns, polyadenylation signals, 5' and 3' untranslated regions, all of which may interact with host cell proteins to carry out transcription and translation.

The term "promoter" as used herein refers to a recognition site of a polynucleotide (DNA or RNA) to which an RNA polymerase binds. An RNA polymerase initiates and transcribes polynucleotides operably linked to the promoter. In particular embodiments, promoters operative in mammalian cells comprise an AT-rich region located approximately 25 to 30 bases upstream from the site where transcription is initiated and/or another sequence found 70 to 80 bases upstream from the start of transcription, a CNCAAT region where N may be any nucleotide. The term "enhancer" refers to a segment of DNA which contains sequences capable of providing enhanced transcription and in some instances can function independent of their orientation relative to another control sequence. An enhancer can function cooperatively or additively with promoters and/or other enhancer elements. The term "promoter/enhancer" refers to a segment of DNA which contains sequences capable of providing both promoter and enhancer functions.

The term "operably linked", refers to a juxtaposition wherein the components described are in a relationship permitting them to function in their intended manner. In one embodiment, the term refers to a functional linkage between an expression control sequence (such as a promoter, and/or enhancer) and a second polynucleotide sequence encoding a polypeptide, wherein the expression control sequence directs transcription of the nucleic acid corresponding to the second sequence.

Illustrative ubiquitous expression control sequences suitable for use in particular embodiments include, but are not limited to, a β-actin promoter, a cytomegalovirus (CMV) immediate early promoter, a simian virus 40 (SV40) (e.g., early or late) promoter, a Moloney murine leukemia virus (MoMLV) promoter, a Rous sarcoma virus (RSV) promoter, a herpes simplex virus (HSV) (thymidine kinase) promoter, an SV40/CD43 promoter, a spleen focus forming virus (SFFV) promoter, an elongation factor 1-alpha (EF1α) short promoter (intronless), an EF1α long promoter containing an intron, a Ubiquitin C (UBC) promoter, a phosphoglycerate kinase-1 (PGK) promoter, a cytomegalovirus enhancer/chicken β-actin (CAG) promoter, and a myeloproliferative sarcoma virus enhancer, negative control region deleted, d1587rev primer-binding site substituted (MND) U3 promoter (Haas et al., Journal of Virology. 2003; 77 (17): 9439-9450).

Illustrative examples of ubiquitous expression control sequences suitable for use in particular embodiments contemplated herein include those comprising polynucleotide sequences set forth in Table 7.

TABLE 7

| SEQ ID NO: | NUCLEIC ACID SEQUENCE |
|---|---|
| 948 | GCGTTACATAACTTACGGTAAATGGCCCGCCTGGCTGACCGCCCAACGACCCCCGCCCATTGAC GTCAATAATGACGTATGTTCCCATAGTAACGCCAATAGGGACTTTCCATTGACGTCAATGGGTG GAGTATTTACGGTAAACTGCCCACTTGGCAGTACATCAAGTGTATCATATGCCAAGTACGCCCC CTATTGACGTCAATGACGGTAAATGGCCCGCCTGGCATTATGCCCAGTACATGACCTTATGGGA CTTTCCTACTTGGCAGTACATCTACGTATTAGTCATCGCTATTACCATGGTCGAGGTGAGCCCC ACGTTCTGCTTCACTCTCCCCATCTCCCCCCCCTCCCCACCCCCAATTTTGTATTTATTTATTT TTTAATTATTTTGTGCAGCGATGGGGGCGGGGGGGGGGGGGGGGCGCGCGCCAGGCGGGGCGGG GCGGGGCGAGGGGCGGGGCGGGGCGAGGCGGAGAGGTGCGGCGGCAGCCAATCAGAGCGGCGCG CTCCGAAAGTTTCCTTTTATGGCGAGGCGGCGGCGGCGGCGGCCCTATAAAAAGCGAAGCGCGC GGCGGGCG |
| 949 | CGTGAGGCTCCGGTGCCCGTCAGTGGGCAGAGCGCACATCGCCCACAGTCCCCGAGAAGTTGGG GGGAGGGGTCGGCAATTGAACCGGTGCCTAGAGAAGGTGGCGCGGGGTAAACTGGGAAAGTGAT GTCGTGTACTGGCTCCGCCTTTTTCCCGAGGGTGGGGGAGAACCGTATATAAGTGCAGTAGTCG CCGTGAACGTTCTTTTTCGCAACGGGTTTGCCGCCAGAACACAGGTAAGTGCCGTGTGTGGTTC CCGCGGGCCTGGCCTCTTTACGGGTTATGGCCCTTGCGTGCCTTGAATTACTTCCACCTGGCTG CAGTACGTGATTCTTGATCCCGAGCTTCGGGTTGGAAGTGGGTGGGAGAGTTCGAGGCCTTGCG CTTAAGGAGCCCCTTCGCCTCGTGCTTGAGTTGAGGCCTGGCCTGGGCGCTGGGGCCGCCGCGT GCGAATCTGGTGGCACCTTCGCGCCTGTCTCGCTGCTTTCGATAAGTCTCTAGCCATTTAAAAT TTTTGATGACCTGCTGCGACGCTTTTTTTCTGGCAAGATAGTCTTGTAAATGCGGGCCAAGATC TGCACACTGGTATTTCGGTTTTTGGGGCCGCGGGCGGCGACGGGGCCCGTGCGTCCCAGCGCAC ATGTTCGGCGAGGCGGGGCCTGCGAGCGCGGCCACCGAGAATCGGACGGGGGTAGTCTCAAGCT GGCCGGCCTGCTCTGGTGCCTGGCCTCGCGCCGCCGTGTATCGCCCCGCCCTGGGCGGCAAGGC TGGCCCGGTCGGCACCAGTTGCGTGAGCGGAAAGATGGCCGCTTCCCGGCCCTGCTGCAGGGAG CTCAAAATGGAGGACGCGGCGCTCGGGAGAGCGGGCGGGTGAGTCACCCACACAAAGGAAAAGG GCCTTTCCGTCCTCAGCCGTCGCTTCATGTGACTCCACGGAGTACCGGGCGCCGTCCAGGCACC TCGATTAGTTCTCGAGCTTTTGGAGTACGTCGTCTTTAGGTTGGGGGGAGGGGTTTTATGCGAT GGAGTTTCCCCACACTGAGTGGGTGGAGACTGAAGTTAGGCCAGCTTGGCACTTGATGTAATTC TCCTTGGAATTTGCCCTTTTTGAGTTTGGATCTTGGTTCATTCTCAAGCCTCAGACAGTGGTTC AAAGTTTTTTTCTTCCATTTCAGGTGTCGTGA |
| 950 | AATGAAAGACCCCACCTGTAGGTTTGGCAAGCTAGGATCAAGGTTAGGAACAGAGAGACAGCAG AATATGGGCCAAACAGGATATCTGTGGTAAGCAGTTCCTGCCCCGGCTCAGGGCCAAGAACAGT TGGAACAGCAGAATATGGGCCAAACAGGATATCTGTGGTAAGCAGTTCCTGCCCCGGCTCAGGG CCAAGAACAGATGGTCCCCAGATGCGGTCCCGCCCTCAGCAGTTTCTAGAGAACCATCAGATGT TTCCAGGGTGCCCCAAGGACCTGAAATGACCCTGTGCCTTATTTGAACTAACCAATCAGTTCGC TTCTCGCTTCTGTTCGCGCGCTTCTGCTCCCCGAGCTCAATAAAAGAGCCCACAACCCCTCACT CGGC |
| 951 | GGGTAGGGGAGGCGCTTTTCCCAAGGCAGTCTGGAGCATGCGCTTTAGCAGCCCCGCTGGGCAC TTGGCGCTACACAAGTGGCCTCTGGCCTCGCACACATTCCACATCCACCGGTAGGCGCCAACCG GCTCCGTTCTTTGGTGGCCCCTTCGCGCCACCTTCTACTCCTCCCCTAGTCAGGAAGTTCCCCC CCGCCCCGCAGCTCGCGTCGTGCAGGACGTGACAAATGGAAGTAGCACGTCTCACTAGTCTCGT GCAGATGGACAGCACCGCTGAGCAATGGAAGCGGGTAGGCCTTTGGGGCAGCGGCCAATAGCAG CTTTGCTCCTTCGCTTTCTGGGCTCAGAGGCTGGGAAGGGGTGGGTCCGGGGGCGGGCTCAGGG GCGGGCTCAGGGGCGGGGCGGGCGCCCGAAGGTCCTCCGGAGGCCCGGCATTCTGCACGCTTCA AAAGCGCACGTCTGCCGCGCTGTTCTCCTCTTCCTCATCTCCGGGCCTTTCG |
| 952 | TGAAAGACCCCACCTGTAGGTTTGGCAAGATAGCTGCAGTAACGCCATTTTGCAAGGCATGGAA AAATACCAAACCAAGAATAGAGAAGTTCAGATCAAGGGCGGGTACATGAAAATAGCTAACGTTG GGCCAAACAGGATATCTGCGGTGAGCAGTTTCGGCCCCGGCCCGGGGCCAAGAACAGATGGTCA CCGCAGTTTCGGCCCCGGCCCGAGGCCAAGAACAGATGGTCCCCAGATATGGCCCAACCCTCAG CAGTTTCTTAAGACCCATCAGATGTTTCCAGGCTCCCCCAAGGACCTGAAATGACCCTGCGCCT TATTTGAATTAACCAATCAGCCTGCTTCTCGCTTCTGTTCGCGCGCTTCTGCTTCCCGAGCTCT ATAAAAGAGCTCACAACCCCTCACTCGGCGCGCCAGTCCTCCGATTGACTGAGTCGCCC |
| 953 | GGCCTCCGCGCCGGGTTTTGGCGCCTCCCGCGGGCGCCCCCCTCCTCACGGCGAGCGCTGCCAC GTCAGACGAAGGGCGCAGCGAGCGTCCTGATCCTTCCGCCCGGACGCTCAGGACAGCGGCCCGC TGCTCATAAGACTCGGCCTTAGAACCCCAGTATCAGCAGAAGGACATTTTAGGACGGGACTTGG GTGACTCTAGGGCACTGGTTTTCTTTCCAGAGAGCGGAACAGGCGAGGAAAAGTAGTCCCTTCT CGGCGATTCTGCGGAGGGATCTCCGTGGGGCGGTGAACGCCGATGATTATATAAGGACGCGCCG GGTGTGGCACAGCTAGTTCCGTCGCAGCCGGGATTTGGGTCGCGGTTCTTGTTTGTGGATCGCT GTGATCGTCACTTGGTGAGTAGCGGGCTGCTGGGCTGGCCGGGGCTTTCGTGGCCGCCGGGCCG CTCGGTGGGACGGAAGCGTGTGGAGAGACCGCCAAGGGCTGTAGTCTGGGTCCGCGAGCAAGGT TGCCCTGAACTGGGGGTTGGGGGGAGCGCAGCAAAATGGCGGCTGTTCCCGAGTCTTGAATGGA AGACGCTTGTGAGGCGGGCTGTGAGGTCGTTGAAACAAGGTGGGGGGCATGGTGGGCGGCAAGA ACCCAAGGTCTTGAGGCCTTCGCTAATGCGGGAAAGCTCTTATTCGGGTGAGATGGGCTGGGGC ACCATCTGGGGACCCTGACGTGAAGTTTGTCACTGACTGGAGAACTCGGTTTGTCGTCTGTTGC GGGGGCGGCAGTTATGGCGGTGCCGTTGGGCAGTGCACCCGTACCTTTGGGAGCGCGCGCCCTC GTCGTGTCGTGACGTCACCCGTTCTGTTGGCTTATAATGCAGGGTGGGGCCACCTGCCGGTAGG TGTGCGGTAGGCTTTTCTCCGTCGCAGGACGCAGGGTTCGGGCCTAGGGTAGGCTCTCCTGAAT CGACAGGCGCCGGACCTCTGGTGAGGGGAGGGATAAGTGAGGCGTCAGTTTCTTTGGTCGGTTT TATGTACCTATCTTCTTAAGTAGCTGAAGCTCCGGTTTTGAACTATGCGCTCGGGGTTGGCGAG TGTGTTTTGTGAAGTTTTTTAGGCACCTTTTGAAATGTAATCATTTGGGTCAATATGTAATTTT CAGTGTTAGACTAGTAAATTGTCCGCTAAATTCTGGCCGTTTTTGGCTTTTTTGTTAGAC |

In particular embodiments, a polynucleotide comprises one or more cell type- or tissue-specific expression control sequences. In particular embodiments a cell type-specific expression control sequence is specific for immune effector cells. In particular embodiments a cell type-specific expression control sequence is a T cell specific promoter, an NK cell specific promoter, an NKT cell specific promoter, or a mucosal-associated invariant T (MAIT) cell promoter.

In particular embodiments, a cell type-specific expression control sequence is selected from the group consisting of a distal lymphocyte protein tyrosine kinase (LCK) promoter (Brenner et al., Proc. Natl. Acad. Sci. USA 99:2936-2941 (2002)), a CD38 promoter (Ji et al., J Biol Chem. 277 (49): 47898-906 (2002)), a CD4 gene promoter (Salmon et al., Proc. Natl. Acad. Sci. USA 90:7739 (1993), a CD2 promoter (Greaves et al., Cell 56:979-86 (1989)), and a TCF7 promoter (van de Wetering et al. J. of Bio. Chem. 267:8530-8536 (1992)).

In particular embodiments, expression of polynucleotide sequences may be modulated by incorporating posttranscriptional regulatory elements into vectors. A variety of posttranscriptional regulatory elements may increase expression of a heterologous nucleic acid, e.g, woodchuck hepatitis virus posttranscriptional regulatory element (WPRE; Zufferey et al., 1999, J. Virol., 73:2886); the posttranscriptional regulatory element present in hepatitis B vims (HPRE) (Huang et al., Mol. Cell. Biol., 5:3864); and the like (Liu et al., 1995, Genes Dev., 9:1766).

Illustrative examples of posttranscriptional control sequences suitable for use in particular embodiments contemplated herein include those comprising polynucleotide sequences set forth in Table 8.

TABLE 8

| SEQ ID NO: | NUCLEIC ACID SEQUENCE |
|---|---|
| 945 | AATCAACCTCTGGATTACAAAATTTGTGAAAGATTGACTGGTATTCTTAACTATGTTGCTC<br>CTTTTACGCTATGTGGATACGCTGCTTTAATGCCTTTGTATCATGCTATTGCTTCCCGTAT<br>GGCTTTCATTTTCTCCTCCTTGTATAAATCCTGGTTGCTGTCTCTTTATGAGGAGTTGTGG<br>CCCGTTGTCAGGCAACGTGGCGTGGTGTGCACTGTGTTTGCTGACGCAACCCCCACTGGTT<br>GGGGCATTGCCACCACCTGTCAGCTCCTTTCCGGGACTTTCGCTTTCCCCCTCCCTATTGC<br>CACGGCGGAACTCATCGCCGCCTGCCTTGCCCGCTGCTGGACAGGGGCTCGGCTGTTGGGC<br>ACTGACAATTCCGTGGTGTTGTCGGGGAAGCTGACGTCCTTTCCATGGCTGCTCGCCTGTG<br>TTGCCACCTGGATTCTGCGCGGGACGTCCTTCTGCTACGTCCCTTCGGCCCTCAATCCAGC<br>GGACCTTCCTTCCCGCGGCCTGCTGCCGGCTCTGCGGCCTCTTCCGCGTCTTCGCCTTCGC<br>CCTCAGACGAGTCGGATCTCCCTTTGGGCCGCCTCCCCGCCTG |
| 946 | AATCAACCTCTGGATTACAAAATTTGTGAAAGATTGACTGGTATTCTTAACTATGTTGCTC<br>CTTTTACGCTATGTGGATACGCTGCTTTAATGCCTTTGTATCATGCTATTGCTTCCCGTAT<br>GGCTTTCATTTTCTCCTCCTTGTATAAATCCTGGTTGCTGTCTCTTTATGAGGAGTTGTGG<br>CCCGTTGTCAGGCAACGTGGCGTGGTGTGCACTGTGTTTGCTGACGCAACCCCCACTGGTT<br>GGGGCATTGCCACCACCTGTCAGCTCCTTTCCGGGACTTTCGCTTTCCCCCTCCCTATTGC<br>CACGGCGGAACTCATCGCCGCCTGCCTTGCCCGCTGCTGGACAGGGGCTCGGCTGTTGGGC<br>ACTGACAATTCCGTGGTGTTGTCGGGGAAGGTCTGCTGAGACTCGGGGCTGCTCGCCTGTG<br>TTGCCACCTGGATTCTGCGCGGGACGTCCTTCTGCTACGTCCCTTCGGCCCTCAATCCAGC<br>GGACCTTCCTTCCCGCGGCCTGCTGCCGGCTCTGCGGCCTCTTCCGCGTCTTCGCCTTCGC<br>CCTCAGACGAGTCGGATCTCCCTTTGGGCCGCCTCCCCGCCTG |
| 947 | AATCAACCTCTGGATTACAAAATTTGTGAAAGATTGACTGATATTCTTAACTATGTTGCTC<br>CTTTTACGCTGTGTGGATATGCTGCTTTAATGCCTCTGTATCATGCTATTGCTTCCCGTAC<br>GGCTTTCGTTTTCTCCTCCTTGTATAAATCCTGGTTGCTGTCTCTTTATGAGGAGTTGTGG<br>CCCGTTGTCCGTCAACGTGGCGTGGTGTGCTCTGTGTTTGCTGACGCAACCCCCACTGGCT<br>GGGGCATTGCCACCACCTGTCAACTCCTTTCTGGGACTTTCGCTTTCCCCCTCCCGATCGC<br>CACGGCAGAACTCATCGCCGCCTGCCTTGCCCGCTGCTGGACAGGGGCTAGGTTGCTGGGC<br>ACTGATAATTCCGTGGTGTTGTC |

In particular embodiments, a vector comprises or encodes (in the case of an RNA vector, e.g., a retroviral vector) an MNDU3 promoter (e.g., SEQ ID NO: 950) operably linked to a polynucleotide encoding a chimeric antigen receptor comprising an anti-BCMA antibody or antigen binding fragment thereof comprising an amino acid set forth in any one of SEQ ID NOS: 11-144, and optionally a polynucleotide comprising a posttranscriptional regulatory element set forth in any one of SEQ ID NOs: 945-947. In particular embodiments, a vector comprises or encodes an MNDU3 promoter operably linked to a polynucleotide encoding a chimeric antigen receptor comprising an anti-BCMA antibody or antigen binding fragment thereof comprising an amino acid set forth in any one of SEQ ID NOs: 20, 30, 39, 50, 59, 70, 80, 90, 100, 101, 105, 109, 113, 117, 121, 125, 129, 133, 137, and 141, and optionally a polynucleotide comprising a posttranscriptional regulatory element set forth in any one of SEQ ID NOs: 945-947. In particular embodiments, a vector comprises or encodes an MNDU3 promoter operably linked to a polynucleotide encoding a chimeric antigen receptor comprising an amino acid sequence set forth in any one of SEQ ID NOS: 165-860, and optionally a polynucleotide comprising a posttranscriptional regulatory element set forth in any one of SEQ ID NOs: 945-947. In particular embodiments, a vector comprises or encodes an MNDU3 promoter operably linked to a polynucleotide encoding a signal peptide comprising an amino acid sequence set forth in any one of SEQ ID NOs: 861, 862, 863, 864, 865, 866, 867, 868, 869, 870, 871, 872, and 873 and a polynucleotide encoding a chimeric antigen receptor comprising an amino acid sequence set forth in any one of SEQ ID NOs: 165-860, and optionally a polynucleotide comprising a posttranscriptional regulatory element set forth in any one of SEQ ID NOs: 945-947. In particular embodiments, a vector comprises or encodes an MNDU3 promoter operably linked to a polynucleotide encoding a chimeric antigen receptor comprising an amino acid sequence set forth in any one of SEQ ID NOs: 189, 237, 261, 333, 357, 429, 477, 525, 573, 597, 621, 645, 669, 693, 717, 741, 765, 789, 813, and 837, and optionally a polynucleotide comprising a posttranscriptional regulatory element set forth in any one of SEQ ID NOs: 945-947. In particular embodiments, a vector comprises or encodes an MNDU3 promoter operably linked to a polynucleotide encoding a signal peptides comprising an amino acid sequence set forth in SEQ ID NO: 861 and a polynucleotide encoding a chimeric antigen receptor comprising an amino acid sequence set forth in any one of SEQ ID NOs: 189, 237, 261, 333, 357, 429, 477, 525, 573, 597, 621, 645, 669, 693, 717, 741, 765, 789, 813, and 837, and optionally a polynucleotide comprising a posttranscriptional regulatory element set forth in any one of SEQ ID NOs: 945-947. In particular embodiments, a vector comprises or encodes an MNDU3 promoter operably linked to a polynucleotide encoding a chimeric antigen receptor comprising a polynucleotide sequence set forth in any one of SEQ ID NOs: 905-944, and optionally a polynucleotide comprising a posttranscriptional regulatory element set forth in any one of SEQ ID NOs: 945-947. In particular embodiments, a vector comprises or encodes an MNDU3 promoter operably linked to a polynucleotide encoding a signal peptide comprising a polynucleotide sequence set forth in SEQ ID NO: 904 and a chimeric antigen receptor comprising a polynucleotide sequence set forth in any one of SEQ ID NOs: 905-924, and optionally a polynucleotide comprising a posttranscriptional regulatory element set forth in any one of SEQ ID NOs: 945-947. In particular embodiments, a vector comprises or encodes an MNDU3 promoter operably linked to a polynucleotide encoding a signal peptide and a chimeric antigen receptor comprising a polynucleotide sequence set forth in any one of SEQ ID NOs: 925-944, and optionally a polynucleotide comprising a posttranscriptional regulatory element set forth in any one of SEQ ID NOs: 945-947.

In particular embodiments, a vector comprises or encodes (in the case of an RNA vector, e.g., a retroviral vector) an EF1α promoter (e.g., SEQ ID NO: 949) operably linked to a polynucleotide encoding a chimeric antigen receptor comprising an anti-BCMA antibody or antigen binding fragment thereof comprising an amino acid set forth in any one of SEQ ID NOs: 11-144, and optionally a polynucleotide comprising a posttranscriptional regulatory element set forth in any one of SEQ ID NOs: 945-947. In particular embodiments, a vector comprises or encodes an EF1α promoter operably linked to a polynucleotide encoding a chimeric antigen receptor comprising an anti-BCMA antibody or antigen binding fragment thereof comprising an amino acid set forth in any one of SEQ ID NOs: 20, 30, 39, 50, 59, 70, 80, 90, 100, 101, 105, 109, 113, 117, 121, 125, 129, 133, 137, and 141, and optionally a polynucleotide comprising a posttranscriptional regulatory element set forth in any one of SEQ ID NOs: 945-947. In particular embodiments, a vector comprises or encodes an EF1α promoter operably linked to a polynucleotide encoding a chimeric antigen receptor comprising an amino acid sequence set forth in any one of SEQ ID NOs: 165-860, and optionally a polynucleotide comprising a posttranscriptional regulatory element set forth in any one of SEQ ID NOs: 945-947. In particular embodiments, a vector comprises or encodes an EF1α promoter operably linked to a polynucleotide encoding a signal peptide comprising an amino acid sequence set forth in any one of SEQ ID NOs: 861, 862, 863, 864, 865, 866, 867, 868, 869, 870, 871, 872, and 873 and a polynucleotide encoding a chimeric antigen receptor comprising an amino acid sequence set forth in any one of SEQ ID NOs: 165-860, and optionally a polynucleotide comprising a posttranscriptional regulatory element set forth in any one of SEQ ID NOs: 945-947. In particular embodiments, a vector comprises or encodes an EF1α promoter operably linked to a polynucleotide encoding a chimeric antigen receptor comprising an amino acid sequence set forth in any one of SEQ ID NOs: 189, 237, 261, 333, 357, 429, 477, 525, 573, 597, 621, 645, 669, 693, 717, 741, 765, 789, 813, and 837, and optionally a polynucleotide comprising a posttranscriptional regulatory element set forth in any one of SEQ ID NOs: 945-947. In particular embodiments, a vector comprises or encodes an EF1α promoter operably linked to a polynucleotide encoding a signal peptide comprising an amino acid sequence set forth in any one of SEQ ID NOs: 861, 862, 863, 864, 865, 866, 867, 868, 869, 870, 871, 872, and 873 and a chimeric antigen receptor comprising an amino acid sequence set forth in any one of SEQ ID NOs: 189, 237, 261, 333, 357, 429, 477, 525, 573, 597, 621, 645, 669, 693, 717, 741, 765, 789, 813, and 837, and optionally a polynucleotide comprising a posttranscriptional regulatory element set forth in any one of SEQ ID NOs: 945-947. In particular embodiments, a vector comprises or encodes an EF1α promoter operably linked to a polynucleotide encoding a chimeric antigen receptor comprising a polynucleotide sequence set forth in any one of SEQ ID NOs: 905-924, and optionally a polynucleotide comprising a posttranscriptional regulatory element set forth in any one of SEQ ID NOs: 945-947. In particular embodiments, a vector comprises or encodes an EF1α promoter operably linked to a polynucleotide encoding a signal peptide comprising a polynucleotide sequence set forth in SEQ ID NO: 904 and a chimeric antigen receptor comprising a polynucleotide sequence set forth in any one of SEQ ID NOs: 905-924, and optionally a polynucleotide comprising a posttranscriptional regulatory element set forth in any one of SEQ ID NOs: 945-947. In particular embodiments, a vector comprises or encodes an EF1α promoter operably linked to a polynucleotide encoding a signal peptide and a chimeric antigen receptor comprising a polynucleotide sequence set forth in any one of SEQ ID NOs: 925-944, and optionally a polynucleotide comprising a posttranscriptional regulatory element set forth in any one of SEQ ID NOs: 945-947.

Efficient expression of polynucleotides can also be increased in some embodiments, by using sequences that increase translational efficiency, e.g., through an increase in mRNA ribosomal binding or an increase in mRNA stability. In certain embodiments, polynucleotides encoding a chimeric antigen receptor comprise a short recognition sequence, i.e., a Kozak sequence, that greatly facilitates the initial binding of mRNA to the small subunit of the ribosome and increases translation. The consensus Kozak sequence is (GCC) RCCATGG (SEQ ID NO: 980), where R is a purine (A or G) (Kozak, Cell. 44:283-92 (1986), and Kozak, Nucleic Acids Res. 15:8125-48 (1987)).

Elements directing the efficient termination and polyadenylation of heterologous nucleic acid transcripts may also increase heterologous gene expression. Transcription termination signals are generally found downstream of the polyadenylation signal. In particular embodiments, vectors comprise a polyadenylation sequence 3' to a sequence to be transcribed and/or expressed. The term "polyadenylation (or poly(A)) signal" refers to a DNA sequence which directs both the termination and polyadenylation of the nascent RNA transcript by RNA polymerase II. Polyadenylation signals can promote mRNA stability by addition of a poly (A) tail to the 3' end of the coding sequence and thus, contribute to increased translational efficiency. Cleavage and polyadenylation are directed by a poly(A) signal in the RNA. The core poly(A) signal for mammalian pre-mRNAs has two recognition elements flanking a cleavage-polyadenylation site. Typically, an almost invariant AAUAAA hexamer lies 20-50 nucleotides upstream of a more variable element rich in U or GU residues. Cleavage of the nascent transcript occurs between these two elements and is coupled to the addition of up to 250 adenosines to the 5' cleavage product. In particular embodiments, the core poly(A) signal is an ideal poly(A) signal (e.g., AATAAA, ATTAAA, AGTAAA). In particular embodiments, the poly(A) signal is an SV40 poly(A) signal, a bovine growth hormone poly(A) signal (BGHpA), a rabbit β-globin poly(A) signal (rβgpA), variants thereof, or another suitable heterologous or endogenous poly(A) signal known in the art. In particular embodiments, the poly(A) signal is synthetic.

In particular embodiments, a polynucleotide comprises or encodes a promoter operably a polynucleotide sequence encoding a chimeric antigen receptor comprising a signal peptide isolated from a polypeptide selected from the group consisting of CD8α, murine IgGκ, human IgGk, CD33, tPA, SEAP, hGM-CSF, gaussian luciferase, CSF2R, B2M, and CD80, wherein the signal peptide is subsequently cleaved from the translated chimeric antigen receptor. In particular embodiments, a polynucleotide comprises or encodes a promoter operably linked to a polynucleotide sequence encoding a chimeric antigen receptor comprising a signal peptide comprising an amino acid sequence set forth in any one of SEQ ID NOs: 861-873. An illustrative example of a polynucleotide encoding a signal peptide is set forth in SEQ ID NO: 904 (ATGGCTCTTCCCGTAAC AGCCCTTTTGTTGCCCCTTGCACTCCTTCTG-CATGCAGCA CGACCG).

In particular embodiments, a polynucleotide comprises one or more miR target sequences inserted into a 5' UTR, intron, and/or 3' UTR to restrict expression in undesired or off-target cell types.

In some embodiments, a polynucleotide comprises an inducible suicide gene to reduce the risk of direct toxicity and/or uncontrolled proliferation. In some embodiment, the suicide gene is caspase-8 or caspase-9. Caspase-9 can be activated using a specific chemical inducer of dimerization (CID).

In some embodiments, a polynucleotide comprises a gene or gene segment that when introduced into a cell, renders the cell susceptible to negative selection. Negative selection suitable for use in particular embodiments include but are not limited to the HSV-TK gene which confers ganciclovir sensitivity; the cellular hypoxanthine phosphribosyltransferase (HPRT) gene, the cellular adenine phosphoribosyltransferase (APRT) gene, and bacterial cytosine deaminase.

In some embodiments, a polynucleotide comprises a gene or gene segment that when introduced into a cell, renders the cell susceptible to positive selection. Positive selection genes suitable for use in particular embodiments contemplated herein include but are not limited to hygromycin-B phosphotransferase gene (hph) which confers resistance to hygromycin B, the amino glycoside phosphotransferase gene (neo or aph) from Tn5 which codes for resistance to the antibiotic G418, the dihydrofolate reductase (DHFR) gene, the adenosine deaminase gene (ADA), and the multi-drug resistance (MDR) gene.

Table 9 sets forth the SEQ ID NOs. and associated nucleic acid sequences encoding chimeric antigen receptor components and chimeric antigen receptors and the corresponding amino acid SEQ ID NO (AA SEQ ID NO.) encoded by the nucleic acid sequence.

TABLE 9

| SEQ ID NO. | AA SEQ ID NO. | NUCLEIC ACID SEQUENCE |
|---|---|---|
| 894 | 145 | ACCACAACACCTGCTCCAAGGCCCCCACACCCGCTCCAACTATAGCCA GCCAACCATTGAGCCTCAGACCTGAAGCTTGCAGGCCCGCAGCAGGAGG CGCCGTCCATACGCGAGGCCTGGACTTCGCGTGTGAT |
| 895 | 146 | ATTGAAGTTATGTATCCTCCTCCTTACCTAGACAATGAGAAGAGCAATG GAACCATTATCCATGTGAAAGGGAAACACCTTTGTCCAAGTCCCCTATT TCCCGGACCTTCTAAGCCC |
| 896 | 148 | GAGTCCAAATATGGTCCCCCGTGCCCACCATGCCCA |
| 897 | 150 | CTTGAGCCCAAATCTTGTGACAAAACTCACACATGCCCACCGTGCCCA |
| 898 | 151 | ATTTATATTTGGGCACCTTTGGCCGGAACATGTGGGGTGTTGCTTCTCT CCCTTGTGATCACTCTGTATTGT |
| 899 | 153 | TTTTGGGTGCTGGTGGTGGTTGGTGGAGTCCTGGCTTGCTATAGCTTGC TAGTAACAGTGGCCTTTATTATTTTCTGGGTG |
| 900 | 159 | AAGCGCGGGAGAAAGAAGCTCCTGTACATCTTCAAGCAGCCTTTTATGC GACCTGTGCAAACCACTCAGGAAGAAGATGGGTGTTCATGCCGCTTCCC CGAGGAGGAAGAAGGAGGGTGTGAACTG |
| 901 | 160 | AGGAGTAAGAGGAGCAGGCTCCTGCACAGTGACTACATGAACATGACTC CCCGCCGCCCCGGGCCCACCCGCAAGCATTACCAGCCCTATGCCCCACC ACGCGACTTCGCAGCCTATCGCTCC |
| 902 | 162 | ACAAAAAAGAAGTATTCATCCAGTGTGCACGACCCTAACGGTGAATACA TGTTCATGAGAGCAGTGAACACAGCCAAAAAATCTAGACTCACAGATGT GACCCTA |
| 903 | 158 | AGGGTGAAATTTTCTAGAAGCGCCGATGCTCCCGCATATCAGCAGGGTC AGAATCAGCTCTACAATGAATTGAATCTCGGCAGGCGAGAAGAGTACGA TGTTCTGGACAAAAGACGGGGCAGGGATCCCGAGATGGGGGGAAAGCCC CGGAGAAAAAATCCTCAGGAGGGGTTGTACAATGAGCTGCAGAAGGACA |

TABLE 9-continued

| SEQ ID NO. | AA SEQ ID NO. | NUCLEIC ACID SEQUENCE |
|---|---|---|
| | | AGATGGCTGAAGCCTATAGCGAGATCGGAATGAAAGGCGAAAGACGCAG AGGCAAGGGGCATGACGGTCTGTACCAGGGTCTCTCTACAGCCACCAAG GACACTTATGATGCGTTGCATATGCAAGCCTTGCCACCCCGC |
| 904 | 861 | ATGGCTCTTCCCGTAACAGCCCTTTTGTTGCCCCTTGCACTCCTTCTGC ATGCAGCACGACCG |
| 905 | 189 | GAGATCGTGCTGACACAGTCTCCCGCCACACTGTCACTGTCTCCAGGCG AAAGAGCCACACTGAGCTGTAGAGCCAGCCAGAGCGTGTCCTCTTACCT GGCCTGGTATCAGCAGAAGCCTGGACAGGCTCCCCGGCTGCTGATCTAC GATGCCAGCAATAGAGCCACAGGCATCCCCGCCAGATTTTCTGGCAGCG GCTCTGGCACCGATTTCACCCTGACCATAAGCAGCCTGGAACCTGAGGA CTTCGCCGTGTACTACTGCCAGCAGAGAGTGGTGTACCCCATCACCTTT GGCGGAGGCACCAAGGTGGAAATCAAAGGCGGCGGAGGAAGCGGAGGCG GAGGATCTGGTGGTGGTGGATCTGGCGGAGGTGGCAGCCAGATCACACT GAAAGAGTCTGGCCCCACACTGGTCAAGCCCACACAGACCCTGACACTG ACCTGCACCTTCAGCGGCTTTAGCCTGAGCACATCTGGCGTCGGCGTTG GCTGGATTAGACAGCCTCCTGGAAAGGCCCTGGAATGGCTGGCCCTGAT CTACTGGAACGACGAGAAGAGATACAGCCCCAGCCTGAAGTCCCGGCTG ACCATCACCAAGGACACCAGCAAGAACCAGGTGGTGCTGACCATGACAA ACATGGACCCCGTGGACACCGCCGTGTATTATTGCGCCAGAGATGAGTA CGGCGGCTTCGACATTTGGGGCCAGGGCACAATGGTCACCGTGTCTAGT ACCACAACACCTGCTCCAAGGCCCCCCACACCCGCTCCAACTATAGCCA GCCAACCATTGAGCCTCAGACCTGAAGCTTGCAGGCCCGCAGCAGGAGG CGCCGTCCATACGCGAGGCCTGGACTTCGCGTGTGATATTTATATTTGG GCACCTTTGGCCGGAACATGTGGGGTGTTGCTTCTCTCCCTTGTGATCA CTCTGTATTGTAAGCGCGGGAGAAAGAAGCTCCTGTACATCTTCAAGCA GCCTTTTATGCGACCTGTGCAAACCACTCAGGAAGAAGATGGGTGTTCA TGCCGCTTCCCCGAGGAGGAAGAAGGAGGGTGTGAACTGAGGGTGAAAT TTTCTAGAAGCGCCGATGCTCCCGCATATCAGCAGGGTCAGAATCAGCT CTACAATGAATTGAATCTCGGCAGGCGAGAAGAGTACGATGTTCTGGAC AAAAGACGGGGCAGGGATCCCGAGATGGGGGGAAAGCCCCGGAGAAAAA ATCCTCAGGAGGGGTTGTACAATGAGCTGCAGAAGGACAAGATGGCTGA AGCCTATAGCGAGATCGGAATGAAAGGCGAAAGACGCAGAGGCAAGGGG CATGACGGTCTGTACCAGGGTCTCTCTACAGCCACCAAGGACACTTATG ATGCGTTGCATATGCAAGCCTTGCCACCCCGC |
| 906 | 237 | GAGATCGTGCTGACCCAGTCCCCTGCTACCCTGAGCCTGTCTCCAGGCG AGCGGGCCACACTGAGCTGTAGAGCTTCTCAGAGCGTGTCCAGCTACCT GGCCTGGTATCAGCAGAAACCTGGCCAGGCCCCTAGACTGCTGATCTAC GACGCCAGCAACCGGGCCACCGGCATCCCCGCCAGATTCAGCGGATCTG GCAGCGGCACAGATTTTACCCTCACCATCAGCAGCCTGGAACCTGAGGA CTTCGCCGTCTACTACTGCCAGCAAAGATTCGACTACCCCATCACCTTC GGCGGCGGAACAAAGGTGGAAATTAAGGGTGGTGGGGGCAGCGGTGGAG GTGGGAGCGGAGGCGGGGGTAGCGGAGGCGGGGGTAGCCAAATCACACT GAAAGAGAGCGGCCCTACACTCGTGAAACCTACCCAGACCCTGACACTG ACATGTACCTTCAGCGGCTTCTCCCTGAGCACCTCTGGCGTCGGCGTTG GATGGATCAGACAGCCTCCAGGCAAGGCCCTGGAATGGCTGGCTCTGAT CTATTGGAACGACGACAAGCGGTACAGCCCCAGCCTGAAGTCTAGACTG ACCATCACAAAGGACACCAGCAAGAACCAGGTGGTGCTGACCATGACAA ATATGGACCCCGTGGACACCGCCGTGTACTACTGCGCCAGAGATGAGTA CGGCGGATTTGATATCTGGGGCCAGGGCACCATGGTGACCGTGTCCAGC ACCACAACACCTGCTCCAAGGCCCCCCACACCCGCTCCAACTATAGCCA GCCAACCATTGAGCCTCAGACCTGAAGCTTGCAGGCCCGCAGCAGGAGG CGCCGTCCATACGCGAGGCCTGGACTTCGCGTGTGATATTTATATTTGG GCACCTTTGGCCGGAACATGTGGGGTGTTGCTTCTCTCCCTTGTGATCA CTCTGTATTGTAAGCGCGGGAGAAAGAAGCTCCTGTACATCTTCAAGCA GCCTTTTATGCGACCTGTGCAAACCACTCAGGAAGAAGATGGGTGTTCA TGCCGCTTCCCCGAGGAGGAAGAAGGAGGGTGTGAACTGAGGGTGAAAT TTTCTAGAAGCGCCGATGCTCCCGCATATCAGCAGGGTCAGAATCAGCT CTACAATGAATTGAATCTCGGCAGGCGAGAAGAGTACGATGTTCTGGAC AAAAGACGGGGCAGGGATCCCGAGATGGGGGGAAAGCCCCGGAGAAAAA ATCCTCAGGAGGGGTTGTACAATGAGCTGCAGAAGGACAAGATGGCTGA AGCCTATAGCGAGATCGGAATGAAAGGCGAAAGACGCAGAGGCAAGGGG CATGACGGTCTGTACCAGGGTCTCTCTACAGCCACCAAGGACACTTATG ATGCGTTGCATATGCAAGCCTTGCCACCCCGC |
| 907 | 261 | CAAGTGCAGCTCGTGGAAAGCGGCGGCGGAGTGGTGCAGCCCGGCCGGA GCCTGAGACTGTCCTGCGCCGCTTCTGGATTTACCTTCAGCAGCTACGG CATGCACTGGGTCAGACAGGCCCCTGGCAAAGGCCTGGAGTGGGTGGCC GTTATCAGCTACGAGGGCAGCAACAAGTATTACGCCGACAGCGTGAAGG GCCGCTTCACAATCTCTAGAGATAATAGCAAGAACACCCTGTACCTGCA GATGAACAGCCTGCGGGCCGAAGATACCGCCGTGTACTACTGTGCTAGA GAGCTGGGCGACGGCATGGACGTGTGGGGACAGGGCACAACCGTGACCG TGTCCTCTGGTGGTGGGGGCAGCGGTGGAGGTGGGAGCGGAGGCGGGGG TAGCGGAGGCGGGGGTAGCGAGATCGTGCTGACCCAGTCCCCTGCTACA CTGAGCCTGTCTCCAGGCGAGCGGGCCACACTGAGCTGTAGAGCTTCTC |

TABLE 9-continued

| SEQ ID NO. | AA SEQ ID NO. | NUCLEIC ACID SEQUENCE |
|---|---|---|
| | | AGAGCGTGTCCAGCTATCTGGCCTGGTTCCAGCAGAAACCTGGCCAGGC CCCTAGACTGCTGATCTACGACGCCAGCAACCGGGCCACCGGCATCCCC GCCAGATTCAGCGGCTCTGGCAGCGGCACCGACTTCACCCTCACCATCA GCAGCCTGGAACCCGAGGATTTTGCCGTCTACTACTGCCAGCAAAGAGT GGACCTGTGGACCTTCGGCGGAGGAACAAAGGTGGAAATCAAGACCACA ACACCTGCTCCAAGGCCCCCCACACCCGCTCCAACTATAGCCAGCCAAC CATTGAGCCTCAGACCTGAAGCTTGCAGGCCCGCAGCAGGAGGCGCCGT CCATACGCGAGGCCTGGACTTCGCGTGTGATATTTATATTTGGGCACCT TTGGCCGGAACATGTGGGGTGTTGCTTCTCTCCCTTGTGATCACTCTGT ATTGTAAGCGCGGGAGAAAGAAGCTCCTGTACATCTTCAAGCAGCCTTT TATGCGACCTGTGCAAACCACTCAGGAAGAAGATGGGTGTTCATGCCGC TTCCCCGAGGAGGAAGAAGGAGGGTGTGAACTGAGGGTGAAATTTTCTA GAAGCGCCGATGCTCCCGCATATCAGCAGGGTCAGAATCAGCTCTACAA TGAATTGAATCTCGGCAGGCGAGAAGAGTACGATGTTCTGGACAAAAGA CGGGGCAGGGATCCCGAGATGGGGGGAAAGCCCCGGAGAAAAATCCTC AGGAGGGGTTGTACAATGAGCTGCAGAAGGACAAGATGGCTGAAGCCTA TAGCGAGATCGGAATGAAAGGCGAAAGACGCAGAGGCAAGGGGCATGAC GGTCTGTACCAGGGTCTCTCTACAGCCACCAAGGACACTTATGATGCGT TGCATATGCAAGCCTTGCCACCCCGC |
| 908 | 333 | GACATCCAGATGACCCAGAGCCCTTCGACCCTATCCGCTTCCGTGGGTG ACCGTGTGACCATCACCTGTCGCGCGTCGCAGAGCATCTCCTCCTGGCT CGCGTGGTACCAACAGAAGCCTGGCAAGGCCCCCAAGCTGCTGATTTAC GACGCCAGTTCCCTGGAGTCTGGCGTGCCATCCCGCTTCTCCGGCAGCG GCAGCGGTACCGAGTTCACCCTGACGATCAGCTCCCTGCAGCCGGATGA CTTTGCTACCTACTACTGTCAGCAGGTCTCCTCCCTCCCCCCCACCTTC GGTGGCGGTACCAAGGTGGAGATCAAGGGCGGCGGCGGCTCTGGTGGCG GAGGTTCTGGCGGGGGAGGTTCGGGGGGGGGAGGCTCCGAGGTGCAACT GGTAGAGAGCGGCGGGGGACTGGTAAAACCCGGCGGCTCCCTGCGGCTG TCATGCGCTGCTAGCGGCTTCACGTTCAGCGATTACTACATGAGTTGGA TCCGCCAGGCCCCCGGGAAGGGTTTGGAGTGGGTCTCGTATATCTCTTC CAGCGGATCTACCATTTACTATGCGGACAGCGTGAAGGGGCGCTTCACC ATATCTCGGGACAACGCCAAGAACTCCCTGTACCTGCAGATGAATTCCC TGCGTGCCGAGGACACGGCCGTGTATTACTGTGCCCGCGACCAGGGCAA CTACGGCGTCGACGTGTGGGGCCAGGGTACAACCGTCACCGTGTCCAGT ACCACAACACCTGCTCCAAGGCCCCCCACACCCGCTCCAACTATAGCCA GCCAACCATTGAGCCTCAGACCTGAAGCTTGCAGGCCCGCAGCAGGAGG CGCCGTCCATACGCGAGGCCTGGACTTCGCGTGTGATATTTATATTTGG GCACCTTTGGCCGGAACATGTGGGGTGTTGCTTCTCTCCCTTGTGATCA CTCTGTATTGTAAGCGCGGGAGAAAGAAGCTCCTGTACATCTTCAAGCA GCCTTTTATGCGACCTGTGCAAACCACTCAGGAAGAAGATGGGTGTTCA TGCCGCTTCCCCGAGGAGGAAGAAGGAGGGTGTGAACTGAGGGTGAAAT TTTCTAGAAGCGCCGATGCTCCCGCATATCAGCAGGGTCAGAATCAGCT CTACAATGAATTGAATCTCGGCAGGCGAGAAGAGTACGATGTTCTGGAC AAAAGACGGGGCAGGGATCCCGAGATGGGGGGAAAGCCCCGGAGAAAAA ATCCTCAGGAGGGGTTGTACAATGAGCTGCAGAAGGACAAGATGGCTGA AGCCTATAGCGAGATCGGAATGAAAGGCGAAAGACGCAGAGGCAAGGGG CATGACGGTCTGTACCAGGGTCTCTCTACAGCCACCAAGGACACTTATG ATGCGTTGCATATGCAAGCCTTGCCACCCCGC |
| 909 | 357 | CAAGTGCAGCTGGTCGAGAGCGGAGGAGGCCTGGTTAAGCCCGGCGGAT CTCTCAGACTGAGCTGCGCCGCTAGCGGCTTTACATTCAGCGACTACTA CATGAGCTGGATCCGGCAGGCCCCTGGCAAGGGCCTGGAATGGGTGTCC TACATCAGCTCCTCCGGCAGCACCATCTACTACGCCGACAGCGTGAAAG GCAGATTCACAATCTCTAGAGATAATGCCAAGAACAGCCTGTACCTGCA GATGAACAGCCTGCGGGCCGAGGACACCGCCGTGTACTATTGTGCTAGA GATCAGGGCAACTACGGCGTGGACGTGTGGGGCCAGGGCACCACCGTGA CCGTGTCTAGCGGTGGTGGGGGCAGCGGTGGAGGTGGGAGCGGAGGCGG GGGTAGCGGAGGCGGGGGTAGCGATATCCAGATGACCCAGTCCCCATCT ACACTGAGCGCCTCTGTGGGCGACCGGGTGACCATTACATGTAGAGCCA GCCAGAGCATCAGCAGCTGGCTGGCTTGGTATCAGCAGAAACCTGGCAA GGCCCCTAAGCTGCTGATCTACGAGGCCAGCAGCCTGGAAAGCGGCGTC CCCAGCAGATTCAGCGGCAGCGGCTCTGGAACAGAGTTCACCCTGACCA TCTCCTCCCTGCAGCCTGACGACTTCGCCACCTACTACTGCCAGCAATC TGATAGCCACCCCATCACCTTTGGCGGAGGCACCAAGGTGGAAATCAAG ACCACAACACCTGCTCCAAGGCCCCCCACACCCGCTCCAACTATAGCCA GCCAACCATTGAGCCTCAGACCTGAAGCTTGCAGGCCCGCAGCAGGAGG CGCCGTCCATACGCGAGGCCTGGACTTCGCGTGTGATATTTATATTTGG GCACCTTTGGCCGGAACATGTGGGGTGTTGCTTCTCTCCCTTGTGATCA CTCTGTATTGTAAGCGCGGGAGAAAGAAGCTCCTGTACATCTTCAAGCA GCCTTTTATGCGACCTGTGCAAACCACTCAGGAAGAAGATGGGTGTTCA TGCCGCTTCCCCGAGGAGGAAGAAGGAGGGTGTGAACTGAGGGTGAAAT TTTCTAGAAGCGCCGATGCTCCCGCATATCAGCAGGGTCAGAATCAGCT CTACAATGAATTGAATCTCGGCAGGCGAGAAGAGTACGATGTTCTGGAC AAAAGACGGGGCAGGGATCCCGAGATGGGGGGAAAGCCCCGGAGAAAAA ATCCTCAGGAGGGGTTGTACAATGAGCTGCAGAAGGACAAGATGGCTGA AGCCTATAGCGAGATCGGAATGAAAGGCGAAAGACGCAGAGGCAAGGGG |

TABLE 9-continued

| SEQ ID NO. | AA SEQ ID NO. | NUCLEIC ACID SEQUENCE |
|---|---|---|
| | | CATGACGGTCTGTACCAGGGTCTCTCTACAGCCACCAAGGACACTTATG<br>ATGCGTTGCATATGCAAGCCTTGCCACCCCGC |
| 910 | 429 | GATATCCAGATGACCCAGTCCCCATCTACACTGAGCGCCTCTGTGGGCG<br>ACCGGGTGACAATTACCTGTAGAGCTAGCCAGAGCATCTCCTCCTGGCT<br>GGCTTGGTACCAGCAAAAACCTGGCAAGGCCCCTAAGCTGCTGATCTAC<br>GAGGCCAGCAGCCTGGAAAGCGGCGTCCCCTCTAGATTCAGCGGCAGCG<br>GCTCTGGAACCGAGTTCACCCTGACAATCAGCAGCCTGCAGCCTGACGA<br>CTTCGCCACCTATTACTGCCAGCAGGCCAACAGCCACCCCATCACCTTT<br>GGCGGAGGCACCAAGGTGGAAATCAAGGGTGGTGGGGCAGCGGTGGAG<br>GTGGGAGCGGAGGCGGGGGTAGCGGAGGCGGGGGTAGCGAGGTGCAGCT<br>GGTGGAAAGCGGCGGAGGACTCGTTAAGCCCGGCGGCAGCCTGAGACTG<br>AGCTGCGCCGCTAGCGGATTTACCTTCAGCGACTACTACATGAGCTGGA<br>TCCGGCAGGCCCCTGGCAAGGGCCTGGAATGGGTCAGCTACATCAGCTC<br>CTCTGGCTCTACAATCTACTACGCCGACAGCGTGAAAGGCAGATTCACC<br>ATCTCTAGAGATAATGCCAAGAACAGCCTGTACCTGCAAATGAACAGCC<br>TGCGGGCCGAGGACACCGCCGTGTACTATTGTGCTAGAGATCAGGGCAA<br>CTACGGCGTGGACGTGTGGGGCCAGGGCACCACCGTGACAGTGTCCTCC<br>ACCACAACACCTGCTCCAAGGCCCCCCACACCCGCTCCAACTATAGCCA<br>GCCAACCATTGAGCCTCAGACCTGAAGCTTGCAGGCCCGCAGCAGGAGG<br>CGCCGTCCATACGCGAGGCCTGGACTTCGCGTGTGATATTTATATTTGG<br>GCACCTTTGGCCGGAACATGTGGGGTGTTGCTTCTCTCCCTTGTGATCA<br>CTCTGTATTGTAAGCGCGGGAGAAAGAAGCTCCTGTACATCTTCAAGCA<br>GCCTTTTATGCGACCTGTGCAAACCACTCAGGAAGAAGATGGGTGTTCA<br>TGCCGCTTCCCCGAGGAGGAAGAAGGAGGGTGTGAACTGAGGGTGAAAT<br>TTTCTAGAAGCGCCGATGCTCCCGCATATCAGCAGGGTCAGAATCAGCT<br>CTACAATGAATTGAATCTCGGCAGGCGAGAAGAGTACGATGTTCTGGAC<br>AAAAGACGGGGCAGGGATCCCGAGATGGGGGGAAAGCCCCGGAGAAAAA<br>ATCCTCAGGAGGGGTTGTACAATGAGCTGCAGAAGGACAAGATGGCTGA<br>AGCCTATAGCGAGATCGGAATGAAAGGCGAAAGACGCAGAGGCAAGGGG<br>CATGACGGTCTGTACCAGGGTCTCTCTACAGCCACCAAGGACACTTATG<br>ATGCGTTGCATATGCAAGCCTTGCCACCCCGC |
| 911 | 477 | GACATCCAGATGACCCAGAGCCCTAGCTCCCTGAGCGCCAGCGTGGGCG<br>ATAGAGTGACCATTACCTGTAGAGCCTCTCAGAGCATCTCCTCCTACCT<br>GAACTGGTATCAGCAGAAACCCGGCAAGGCCCCTAAGCTGCTGATCTAC<br>GCCGCTAGCAGCCTGCAGTCTGGCGTCCCCAGCCGGTTCAGCGGCAGCG<br>GATCTGGCACCGACTTCACCCTGACAATCAGCAGCCTGCAACCTGAGGA<br>CTTTGCTACATACTACTGCCAGCAGGCCCACAGCTCTCCAATCACCTTC<br>GGCGGCGGAACAAAGGTGGAAATCAAGGGTGGTGGGGCAGCGGTGGAG<br>GTGGGAGCGGAGGCGGGGGTAGCGGAGGCGGGGGTAGCGAGGTGCAGCT<br>GCTGGAAAGCGGAGGCGGACTCGTTCAACCTGGCGGCAGCCTGAGACTG<br>AGCTGCGCCGCTTCTGGATTTACCTTCAGCAACTACGCCATGAGCTGGG<br>TGCGGCAGGCCCCTGGCAAAGGCCTGGAATGGGTCTCCGCCATCAGCGG<br>CTCTGGCGGCTCCACCTACTACGCCGACAGCGTGAAGGGCAGATTCACC<br>ATCTCTAGAGATAATAGCAAGAACACCCTGTACCTGCAGATGAACAGCC<br>TGCGGGCCGAGGACACCGCCGTGTACTATTGTGCTAGACCCGGAGATGG<br>CTACTACGAGGGCGTGTACTTCGACTACTGGGGCCAGGGCACACTGGTG<br>ACAGTGTCCAGCACCACAACACCTGCTCCAAGGCCCCCCACACCCGCTC<br>CAACTATAGCCAGCCAACCATTGAGCCTCAGACCTGAAGCTTGCAGGCC<br>CGCAGCAGGAGGCGCCGTCCATACGCGAGGCCTGGACTTCGCGTGTGAT<br>ATTTATATTTGGGCACCTTTGGCCGGAACATGTGGGGTGTTGCTTCTCT<br>CCCTTGTGATCACTCTGTATTGTAAGCGCGGGAGAAAGAAGCTCCTGTA<br>CATCTTCAAGCAGCCTTTTATGCGACCTGTGCAAACCACTCAGGAAGAA<br>GATGGGTGTTCATGCCGCTTCCCCGAGGAGGAAGAAGGAGGGTGTGAAC<br>TGAGGGTGAAATTTTCTAGAAGCGCCGATGCTCCCGCATATCAGCAGGG<br>TCAGAATCAGCTCTACAATGAATTGAATCTCGGCAGGCGAGAAGAGTAC<br>GATGTTCTGGACAAAAGACGGGGCAGGGATCCCGAGATGGGGGGAAAGC<br>CCCGGAGAAAAAATCCTCAGGAGGGGTTGTACAATGAGCTGCAGAAGGA<br>CAAGATGGCTGAAGCCTATAGCGAGATCGGAATGAAAGGCGAAAGACGC<br>AGAGGCAAGGGGCATGACGGTCTGTACCAGGGTCTCTCTACAGCCACCA<br>AGGACACTTATGATGCGTTGCATATGCAAGCCTTGCCACCCCGC |
| 912 | 525 | GATATTCAGATGACCCAGAGCCCATCTAGCCTGAGCGCCAGCGTGGGCG<br>ATAGAGTGACCATCACCTGTCAGGCCTCTCAGGACATCGCTAATTACCT<br>GAACTGGTATCAGCAGAAACCCGGCAAGGCCCCTAAGCTGCTGATCTAC<br>GACGCCTCCAACCTGGAAACCGGCGTGCCCAGCCGGTTCAGCGGCAGCG<br>GATCTGGCACAGACTTCACCTTTACCATCAGCTCCCTCCAGCCTGAGGA<br>CATCGCCACATACTACTGCCAGCAACACTTCAACCTGCCTCTGACCTTC<br>GGCGGCGGAACAAAGGTCGAGATCAAGGGTGGTGGGGCAGCGGTGGAG<br>GTGGGAGCGGAGGCGGGGGTAGCGGAGGCGGGGGTAGCCAAATCACCCT<br>GAAAGAGAGCGGACCTACACTGGTCAAGCCTACCCAGACACTGACCCTC<br>ACATGTACATTCAGCGGCTTTAGCCTGAGCACCTCCGGCGTGGGAGTGG<br>GCTGGATCAGACAGCCCCCCGGCAAGGCCCTGGAATGGCTGGCTCTGAT<br>CTATTGGAATGACGAGAAGCGGTACAGCCCTAGCCTGAAATCTAGACTG<br>ACAATCACCAAGGACACCAGCAAGAACCAGGTGGTGCTGACCATGACCA<br>ACATGGATCCTGTGGATACCGCCGTGTACTACTGCGCCAGAGAAGGCTC |

TABLE 9-continued

| SEQ ID NO. | AA SEQ ID NO. | NUCLEIC ACID SEQUENCE |
|---|---|---|
| | | TCACGACTACAAGAGCTCCAACTGGTTCGACCCATGGGGCCAGGGCACC CTGGTTACAGTGTCTAGCACCACAACACCTGCTCCAAGGCCCCCCACAC CCGCTCCAACTATAGCCAGCCAACCATTGAGCCTCAGACCTGAAGCTTG CAGGCCCGCAGCAGGAGGCGCCGTCCATACGCGAGGCCTGGACTTCGCG TGTGATATTTATATTTGGGCACCTTTGGCCGGAACATGTGGGGTGTTGC TTCTCTCCCTTGTGATCACTCTGTATTGTAAGCGCGGGAGAAAGAAGCT CCTGTACATCTTCAAGCAGCCTTTTATGCGACCTGTGCAAACCACTCAG GAAGAAGATGGGTGTTCATGCCGCTTCCCCGAGGAGGAAGAAGGAGGGT GTGAACTGAGGGTGAAATTTTCTAGAAGCGCCGATGCTCCCGCATATCA GCAGGGTCAGAATCAGCTCTACAATGAATTGAATCTCGGCAGGCGAGAA GAGTACGATGTTCTGGACAAAAGACGGGGCAGGGATCCCGAGATGGGGG GAAAGCCCCGGAGAAAAAATCCTCAGGAGGGGTTGTACAATGAGCTGCA GAAGGACAAGATGGCTGAAGCCTATAGCGAGATCGGAATGAAAGGCGAA AGACGCAGAGGCAAGGGGCATGACGGTCTGTACCAGGGTCTCTCTACAG CCACCAAGGACACTTATGATGCGTTGCATATGCAAGCCTTGCCACCCCG C |
| 913 | 573 | GATATCGTGATGACCCAATCTCCACTGAGCCTGCCTGTGACACCTGGCG AGCCTGCTTCTATCAGCTGTAGAAGCAGCCAGTCCCTGCTGCACAGCAA CGGCTACAACTACCTGGACTGGTATCTGCAGAAACCCGGCCAGAGCCCC CAGCTGCTGATCTACCTCGGCTCTAATCGGGCCAGCGGAGTGCCTGATA GATTCAGCGGAAGCGGCTCCGGCACCGACTTCACCCTGAAGATCAGCAG AGTGGAAGCCGAGGACGTGGGCGTCTACTACTGCATGCAGGCCCTGGGC CTGATTACATTTGGCGGCGGAACCAAGGTGGAAATCAAGGGTGGTGGGG GCAGCGGTGGAGGTGGGAGCGGAGGCGGGGGTAGCGGAGGCGGGGGTAG CGAAGTGCAGCTGGTTGAGAGCGGCGGCGGACTGGTGAAGCCCGGAGGC AGCCTCAGACTGAGCTGTGCTGCTTCTGGCTTTACCTTCAGCTCTTATA GCATGAACTGGGTGCGGCAGGCCCCTGGCAAGGGCCTGGAATGGGTCAG CTCCATCAGCTCTTCTAGCAGCTACATCTACTACGCCGACAGCGTGAAG GGCAGATTCACCATCAGCAGAGATAACGCCAAGAACAGCCTGTACCTGC AGATGAATAGCCTGCGGGCCGAGGACACCGCCGTGTACTACTGCGCCAG AGCCGGCGACACCTACAGCGCCGCCGATTACTACTACATGGACGTGTGG GGCAAAGGAACAACCGTGACAGTGTCCTCCACCACAACACCTGCTCCAA GGCCCCCCACACCCGCTCCAACTATAGCCAGCCAACCATTGAGCCTCAG ACCTGAAGCTTGCAGGCCCGCAGCAGGAGGCGCCGTCCATACGCGAGGC CTGGACTTCGCGTGTGATATTTATATTTGGGCACCTTTGGCCGGAACAT GTGGGGTGTTGCTTCTCTCCCTTGTGATCACTCTGTATTGTAAGCGCGG GAGAAAGAAGCTCCTGTACATCTTCAAGCAGCCTTTTATGCGACCTGTG CAAACCACTCAGGAAGAAGATGGGTGTTCATGCCGCTTCCCCGAGGAGG AAGAAGGAGGGTGTGAACTGAGGGTGAAATTTTCTAGAAGCGCCGATGC TCCCGCATATCAGCAGGGTCAGAATCAGCTCTACAATGAATTGAATCTC GGCAGGCGAGAAGAGTACGATGTTCTGGACAAAAGACGGGGCAGGGATC CCGAGATGGGGGGAAAGCCCCGGAGAAAAAATCCTCAGGAGGGGTTGTA CAATGAGCTGCAGAAGGACAAGATGGCTGAAGCCTATAGCGAGATCGGA ATGAAAGGCGAAAGACGCAGAGGCAAGGGGCATGACGGTCTGTACCAGG GTCTCTCTACAGCCACCAAGGACACTTATGATGCGTTGCATATGCAAGC CTTGCCACCCCGC |
| 914 | 597 | GAAGTGCAACTGCTGGAAAGCGGCGGAGGCCTGGTCCAGCCCGGCGGCT CTCTGCGGCTCAGCTGCGCCGCTTCTGGATTTACCTTCGGCAGCGAGGC TATGAGCTGGGTGCGGCAGGCCCCTGGAAAAGAGAGAGAGCTGGTGTCC GCCATCAGCGGCAGCGGCGAGGTGACCTACTACGCCGACAGCGTGAAGG GCAGATTCACCATCTCTAGAGATAATAGCAAGAACACCCTGTACCTGCA GATGAACAGCCTGAGAGCCGAGGACACCGCCGTGTACTATTGTCAGAGA CTGGTGGAAGCCAAGCGGCACTGGGGCCAGGGCACACAGGTTACAGTGT CCAGCACCACAACACCTGCTCCAAGGCCCCCCACACCCGCTCCAACTAT AGCCAGCCAACCATTGAGCCTCAGACCTGAAGCTTGCAGGCCCGCAGCA GGAGGCGCCGTCCATACGCGAGGCCTGGACTTCGCGTGTGATATTTATA TTTGGGCACCTTTGGCCGGAACATGTGGGGTGTTGCTTCTCTCCCTTGT GATCACTCTGTATTGTAAGCGCGGGAGAAAGAAGCTCCTGTACATCTTC AAGCAGCCTTTTATGCGACCTGTGCAAACCACTCAGGAAGAAGATGGGT GTTCATGCCGCTTCCCCGAGGAGGAAGAAGGAGGGTGTGAACTGAGGGT GAAATTTTCTAGAAGCGCCGATGCTCCCGCATATCAGCAGGGTCAGAAT CAGCTCTACAATGAATTGAATCTCGGCAGGCGAGAAGAGTACGATGTTC TGGACAAAAGACGGGGCAGGGATCCCGAGATGGGGGGAAAGCCCCGGAG AAAAAATCCTCAGGAGGGGTTGTACAATGAGCTGCAGAAGGACAAGATG GCTGAAGCCTATAGCGAGATCGGAATGAAAGGCGAAAGACGCAGAGGCA AGGGGCATGACGGTCTGTACCAGGGTCTCTCTACAGCCACCAAGGACAC TTATGATGCGTTGCATATGCAAGCCTTGCCACCCCGC |
| 915 | 621 | GAAGTGCAACTGCTGGAATCTGGCGGAGGACTGGTGCAGCCCGGCGGCA GCCTGCGGCTGAGCTGTGCTGCTTCTGGCTTTACCTTCGAGTCTGAGGC CATGAGCTGGTATAGACAGGCCCCTGGCAAGGAAAGAGAGCTGGTCAGC GTGATCACCAGCGAGGGCTCCACCTACTACGCCGACAGCGTGAAAGGCA GATTCACAATCAGCCGGGACAATAGCAAGAACACCCTGTACCTGCAGAT GAACAGCCTGCGCGCCGAAGATACAGCCGTGTACTACTGCGCCCACATC GAGTGGGAGACAAGACTCAACTGGGGCCAGGGCACCCAGGTGACCGTGT |

TABLE 9-continued

| SEQ ID NO. | AA SEQ ID NO. | NUCLEIC ACID SEQUENCE |
|---|---|---|
| | | CCAGCACCACAACACCTGCTCCAAGGCCCCCACACCCGCTCCAACTAT<br>AGCCAGCCAACCATTGAGCCTCAGACCTGAAGCTTGCAGGCCCGCAGCA<br>GGAGGCGCCGTCCATACGCGAGGCCTGGACTTCGCGTGTGATATTTATA<br>TTTGGGCACCTTTGGCCGGAACATGTGGGGTGTTGCTTCTCTCCCTTGT<br>GATCACTCTGTATTGTAAGCGCGGGAGAAAGAAGCTCCTGTACATCTTC<br>AAGCAGCCTTTTATGCGACCTGTGCAAACCACTCAGGAAGAAGATGGGT<br>GTTCATGCCGCTTCCCCGAGGAGGAAGAAGGAGGGTGTGAACTGAGGGT<br>GAAATTTTCTAGAAGCGCCGATGCTCCCGCATATCAGCAGGGTCAGAAT<br>CAGCTCTACAATGAATTGAATCTCGGCAGGCGAGAAGAGTACGATGTTC<br>TGGACAAAAGACGGGGCAGGGATCCCGAGATGGGGGGAAAGCCCCGGAG<br>AAAAAATCCTCAGGAGGGGTTGTACAATGAGCTGCAGAAGGACAAGATG<br>GCTGAAGCCTATAGCGAGATCGGAATGAAAGGCGAAAGACGCAGAGGCA<br>AGGGGCATGACGGTCTGTACCAGGGTCTCTCTACAGCCACCAAGGACAC<br>TTATGATGCGTTGCATATGCAAGCCTTGCCACCCCGC |
| 916 | 645 | GAGGTGCAGCTGCTGGAAAGCGGAGGGGGCCTGGTCCAACCCGGCGGGT<br>CTCTTCGCCTAAGCTGTGCCGCTTCTGGCTTCACCTTCGACGAGTACAC<br>CATGCACTGGTTCAGACAGGCCCCCGGCAAGGAGCGCGAGTTCGTCAGT<br>GCAATCAGCGGAGGCGGTAGCGAGACTTATTACGCGGACTCCGTGAAGG<br>GCCGCTTCACCATTAGCCGCGACAACTCCAAGAACACGCTGTACCTGCA<br>GATGAATTCGCTGCGCGCCGAAGATACGGCCGTGTACTACTGTGCCGCT<br>GGTGGGGAGGAGGCTGGCGTGGGCTATTGGGGCCAGGGCACCCAGGTCA<br>CCGTGTCGTCCACCACAACACCTGCTCCAAGGCCCCCACACCCGCTCC<br>AACTATAGCCAGCCAACCATTGAGCCTCAGACCTGAAGCTTGCAGGCCC<br>GCAGCAGGAGGCGCCGTCCATACGCGAGGCCTGGACTTCGCGTGTGATA<br>TTTATATTTGGGCACCTTTGGCCGGAACATGTGGGGTGTTGCTTCTCTC<br>CCTTGTGATCACTCTGTATTGTAAGCGCGGGAGAAAGAAGCTCCTGTAC<br>ATCTTCAAGCAGCCTTTTATGCGACCTGTGCAAACCACTCAGGAAGAAG<br>ATGGGTGTTCATGCCGCTTCCCCGAGGAGGAAGAAGGAGGGTGTGAACT<br>GAGGGTGAAATTTTCTAGAAGCGCCGATGCTCCCGCATATCAGCAGGGT<br>CAGAATCAGCTCTACAATGAATTGAATCTCGGCAGGCGAGAAGAGTACG<br>ATGTTCTGGACAAAAGACGGGGCAGGGATCCCGAGATGGGGGGAAAGCC<br>CCGGAGAAAAAATCCTCAGGAGGGGTTGTACAATGAGCTGCAGAAGGAC<br>AAGATGGCTGAAGCCTATAGCGAGATCGGAATGAAAGGCGAAAGACGCA<br>GAGGCAAGGGGCATGACGGTCTGTACCAGGGTCTCTCTACAGCCACCAA<br>GGACACTTATGATGCGTTGCATATGCAAGCCTTGCCACCCCGC |
| 917 | 669 | GAGGTGCAGCTGCTGGAGAGCGGAGGCGGCCTCGTGCAGCCAGGAGGTT<br>CCCTACGACTCTCCTGTGCCGCCAGCGGCTTCACCTTCGAGGACTACGC<br>CATGAGTTGGTTCCGCCAGGCCCCGGGGAAGGAGCGCGAGGGCGTGAGC<br>GCGATTTCTGGAAAGGGCGGCTCCACCTATTACGCGGACTCCGTGAAGG<br>GTCGCTTTACCATCTCTCGCGACAACTCCAAGAACACGCTGTACCTGCA<br>GATGAATAGCCTGCGCGCTGAGGACACTGCCGTGTACTACTGTGCTGTC<br>TTGGACGAGGAGGCCGGCGCAGAGGGCGGCTATTGGGGCCAGGGTACCC<br>AGGTCACCGTGTCGTCCACCACAACACCTGCTCCAAGGCCCCCACACC<br>CGCTCCAACTATAGCCAGCCAACCATTGAGCCTCAGACCTGAAGCTTGC<br>AGGCCCGCAGCAGGAGGCGCCGTCCATACGCGAGGCCTGGACTTCGCGT<br>GTGATATTTATATTTGGGCACCTTTGGCCGGAACATGTGGGGTGTTGCT<br>TCTCTCCCTTGTGATCACTCTGTATTGTAAGCGCGGGAGAAAGAAGCTC<br>CTGTACATCTTCAAGCAGCCTTTTATGCGACCTGTGCAAACCACTCAGG<br>AAGAAGATGGGTGTTCATGCCGCTTCCCCGAGGAGGAAGAAGGAGGGTG<br>TGAACTGAGGGTGAAATTTTCTAGAAGCGCCGATGCTCCCGCATATCAG<br>CAGGGTCAGAATCAGCTCTACAATGAATTGAATCTCGGCAGGCGAGAAG<br>AGTACGATGTTCTGGACAAAAGACGGGGCAGGGATCCCGAGATGGGGGG<br>AAAGCCCCGGAGAAAAAATCCTCAGGAGGGGTTGTACAATGAGCTGCAG<br>AAGGACAAGATGGCTGAAGCCTATAGCGAGATCGGAATGAAAGGCGAAA<br>GACGCAGAGGCAAGGGGCATGACGGTCTGTACCAGGGTCTCTCTACAGC<br>CACCAAGGACACTTATGATGCGTTGCATATGCAAGCCTTGCCACCCCGC |
| 918 | 693 | GAGGTGCAACTGCTGGAAAGCGGCGGTGGACTGGTGCAGCCCGGCGGCA<br>GCCTGAGACTGTCTTGTGCTGCTTCTGGATTTACATTCGACAGATACGC<br>CATGAGCTGGTTCCGCCAGGCCCCTGGCAAAGAGCGGGAAGGCGTGTCC<br>GCCATCTCCACAAGCGGAGATAGCACATACTATGCCGACAGCGTGAAGG<br>GCAGATTCACCATCAGCAGAGATAATAGCAAGAACACCCTGTACCTGCA<br>GATGAACAGCCTCCGGGCCGAGGACACCGCCGTCTACTACTGCGCCGTG<br>CTGGACGAGGAAGCCGGCGCCGAGGGCGGCTACTGGGGCCAGGGCACCC<br>AGGTGACCGTGTCTAGCACCACAACACCTGCTCCAAGGCCCCCACACC<br>CGCTCCAACTATAGCCAGCCAACCATTGAGCCTCAGACCTGAAGCTTGC<br>AGGCCCGCAGCAGGAGGCGCCGTCCATACGCGAGGCCTGGACTTCGCGT<br>GTGATATTTATATTTGGGCACCTTTGGCCGGAACATGTGGGGTGTTGCT<br>TCTCTCCCTTGTGATCACTCTGTATTGTAAGCGCGGGAGAAAGAAGCTC<br>CTGTACATCTTCAAGCAGCCTTTTATGCGACCTGTGCAAACCACTCAGG<br>AAGAAGATGGGTGTTCATGCCGCTTCCCCGAGGAGGAAGAAGGAGGGTG<br>TGAACTGAGGGTGAAATTTTCTAGAAGCGCCGATGCTCCCGCATATCAG<br>CAGGGTCAGAATCAGCTCTACAATGAATTGAATCTCGGCAGGCGAGAAG<br>AGTACGATGTTCTGGACAAAAGACGGGGCAGGGATCCCGAGATGGGGGG<br>AAAGCCCCGGAGAAAAAATCCTCAGGAGGGGTTGTACAATGAGCTGCAG |

TABLE 9-continued

| SEQ ID NO. | AA SEQ ID NO. | NUCLEIC ACID SEQUENCE |
|---|---|---|
| | | AAGGACAAGATGGCTGAAGCCTATAGCGAGATCGGAATGAAAGGCGAAA GACGCAGAGGCAAGGGGCATGACGGTCTGTACCAGGGTCTCTCTACAGC CACCAAGGACACTTATGATGCGTTGCATATGCAAGCCTTGCCACCCCGC |
| 919 | 717 | GAGGTGCAACTGCTGGAAAGCGGCGGAGGACTCGTCCAGCCCGGCGGCA GCCTGCGGCTGAGCTGTGCTGCTTCTGGATTTACCTTCGCCAGCGACGC CATGAGCTGGTATAGACAGGCCCCTGGCAAAGAGCGGGAACTGGTGTCC GCCATCAGCGGCTCTGGCGGCTCCACCTACTACGCCGATAGCGTGAAGG GCAGATTCACAATCTCTAGAGATAATAGCAAGAACACCCTGTACCTGCA GATGAACAGCCTGAGAGCCGAGGACACCGCCGTGTACTACTGCGCCGCT CACGACAGCGGCGAGGCCTACCTGGCCTTCGACTACTGGGGCCAGGGCA CACAGGTGACCGTGTCTAGCACCACAACACCTGCTCCAAGGCCCCCCAC ACCCGCTCCAACTATAGCCAGCCAACCATTGAGCCTCAGACCTGAAGCT TGCAGGCCCGCAGCAGGAGGCGCCGTCCATACGCGAGGCCTGGACTTCG CGTGTGATATTTATATTTGGGCACCTTTGGCCGGAACATGTGGGGTGTT GCTTCTCTCCCTTGTGATCACTCTGTATTGTAAGCGCGGGAGAAAGAAG CTCCTGTACATCTTCAAGCAGCCTTTTATGCGACCTGTGCAAACCACTC AGGAAGAAGATGGGTGTTCATGCCGCTTCCCCGAGGAGGAAGAAGGAGG GTGTGAACTGAGGGTGAAATTTTCTAGAAGCGCCGATGCTCCCGCATAT CAGCAGGGTCAGAATCAGCTCTACAATGAATTGAATCTCGGCAGGCGAG AAGAGTACGATGTTCTGGACAAAAGACGGGGCAGGGATCCCGAGATGGG GGGAAAGCCCCGGAGAAAAAATCCTCAGGAGGGGTTGTACAATGAGCTG CAGAAGGACAAGATGGCTGAAGCCTATAGCGAGATCGGAATGAAAGGCG AAAGACGCAGAGGCAAGGGGCATGACGGTCTGTACCAGGGTCTCTCTAC AGCCACCAAGGACACTTATGATGCGTTGCATATGCAAGCCTTGCCACCC CGC |
| 920 | 741 | GAGGTGCAACTGCTGGAAAGCGGCGGAGGACTCGTCCAGCCCGGCGGCA GCCTGAGGCTGAGCTGTGCTGCTTCTGGCTTTACCTTCGACTCCTACAC AATGAGCTGGTATAGACAGGCCCCTGGCAAGGAGCGGGAACTGGTGTCC GCCATCAGCGGCCACGGCGACTCTACATACTACGCCGACAGCGTGAAAG GCAGATTCACAATCTCTAGAGATAATAGCAAGAACACCCTGTACCTGCA GATGAACAGCCTGCGGGCCGAGGACACCGCCGTGTACTACTGCACCAGA ATCAGCATCACCACCGAGTGGCTGGCCGGAGATTACTGGGGCCAGGGCA CCCAGGTGACAGTGTCCAGCACCACAACACCTGCTCCAAGGCCCCCCAC ACCCGCTCCAACTATAGCCAGCCAACCATTGAGCCTCAGACCTGAAGCT TGCAGGCCCGCAGCAGGAGGCGCCGTCCATACGCGAGGCCTGGACTTCG CGTGTGATATTTATATTTGGGCACCTTTGGCCGGAACATGTGGGGTGTT GCTTCTCTCCCTTGTGATCACTCTGTATTGTAAGCGCGGGAGAAAGAAG CTCCTGTACATCTTCAAGCAGCCTTTTATGCGACCTGTGCAAACCACTC AGGAAGAAGATGGGTGTTCATGCCGCTTCCCCGAGGAGGAAGAAGGAGG GTGTGAACTGAGGGTGAAATTTTCTAGAAGCGCCGATGCTCCCGCATAT CAGCAGGGTCAGAATCAGCTCTACAATGAATTGAATCTCGGCAGGCGAG AAGAGTACGATGTTCTGGACAAAAGACGGGGCAGGGATCCCGAGATGGG GGGAAAGCCCCGGAGAAAAAATCCTCAGGAGGGGTTGTACAATGAGCTG CAGAAGGACAAGATGGCTGAAGCCTATAGCGAGATCGGAATGAAAGGCG AAAGACGCAGAGGCAAGGGGCATGACGGTCTGTACCAGGGTCTCTCTAC AGCCACCAAGGACACTTATGATGCGTTGCATATGCAAGCCTTGCCACCC CGC |
| 921 | 765 | GAGGTGCAGCTGCTGGAAAGCGGAGGAGGCCTGGTCCAACCTGGCGGCA GCCTGCGGCTGAGCTGCGCCGCTTCTGGCTTCACCTTCAGCAGCTACGC CATGAGCTGGTTCCGGCAGGCCCCTGGCAAGGAAAGAGAGTTCGTGTCT TTTATCAGCGGATCTGGCGACTCCACCTACTACGCTGATAGCGTGAAAG GCAGATTTACCATCTCTAGAGATAATAGCAAGAACACCCTGTACCTCCA GATGAACAGCCTGCGCGCCGAGGACACAGCCGTGTACTATTGTACCAGA TGGCCTTACGACTTCGAGGAACCAAGCGAGCCCGGCGTGTACTGGGGCC AGGGCACACAGGTGACAGTGTCCTCCACCACAACACCTGCTCCAAGGCC CCCCACACCCGCTCCAACTATAGCCAGCCAACCATTGAGCCTCAGACCT GAAGCTTGCAGGCCCGCAGCAGGAGGCGCCGTCCATACGCGAGGCCTGG ACTTCGCGTGTGATATTTATATTTGGGCACCTTTGGCCGGAACATGTGG GGTGTTGCTTCTCTCCCTTGTGATCACTCTGTATTGTAAGCGCGGGAGA AAGAAGCTCCTGTACATCTTCAAGCAGCCTTTTATGCGACCTGTGCAAA CCACTCAGGAAGAAGATGGGTGTTCATGCCGCTTCCCCGAGGAGGAAGA AGGAGGGTGTGAACTGAGGGTGAAATTTTCTAGAAGCGCCGATGCTCCC GCATATCAGCAGGGTCAGAATCAGCTCTACAATGAATTGAATCTCGGCA GGCGAGAAGAGTACGATGTTCTGGACAAAAGACGGGGCAGGGATCCCGA GATGGGGGGAAAGCCCCGGAGAAAAAATCCTCAGGAGGGGTTGTACAAT GAGCTGCAGAAGGACAAGATGGCTGAAGCCTATAGCGAGATCGGAATGA AAGGCGAAAGACGCAGAGGCAAGGGGCATGACGGTCTGTACCAGGGTCT CTCTACAGCCACCAAGGACACTTATGATGCGTTGCATATGCAAGCCTTG CCACCCCGC |
| 922 | 789 | GAGGTGCAGCTGCTGGAAAGCGGCGGAGGCCTGGTGCAACCTGGCGGAT CTCTCAGACTGAGCTGTGCTGCTTCTGGCTTCACATTCACCGACTACGA CATGAGCTGGTATAGACAGGCCCCTGGAAAAGAGCGGGAACTGGTCTCC GTGATCCACAGCGGCGGCTCCACCTACTACGCCGATAGCGTGAAGGGCA |

TABLE 9-continued

| SEQ ID NO. | AA SEQ ID NO. | NUCLEIC ACID SEQUENCE |
|---|---|---|
| | | GATTCACCATCAGCAGAGATAATAGCAAGAACACCCTGTACCTGCAGAT GAACAGCCTGCGGGCCGAGGACACCGCCGTGTACTACTGCGCCCCCGGC TACTACAGCGACCTGTCTTTTGATTATTACAACTTCGACTACTGGGGCC AGGGCACACAGGTGACAGTGTCCAGCACCACAACACCTGCTCCAAGGCC CCCCACACCCGCTCCAACTATAGCCAGCCAACCATTGAGCCTCAGACCT GAAGCTTGCAGGCCCGCAGCAGGAGGCGCCGTCCATACGCGAGGCCTGG ACTTCGCGTGTGATATTTATATTTGGGCACCTTTGGCCGGAACATGTGG GGTGTTGCTTCTCTCCCTTGTGATCACTCTGTATTGTAAGCGCGGGAGA AAGAAGCTCCTGTACATCTTCAAGCAGCCTTTTATGCGACCTGTGCAAA CCACTCAGGAAGAAGATGGGTGTTCATGCCGCTTCCCCGAGGAGGAAGA AGGAGGGTGTGAACTGAGGGTGAAATTTTCTAGAAGCGCCGATGCTCCC GCATATCAGCAGGGTCAGAATCAGCTCTACAATGAATTGAATCTCGGCA GGCGAGAAGAGTACGATGTTCTGGACAAAAGACGGGGCAGGGATCCCGA GATGGGGGGAAAGCCCCGGAGAAAAAATCCTCAGGAGGGGTTGTACAAT GAGCTGCAGAAGGACAAGATGGCTGAAGCCTATAGCGAGATCGGAATGA AAGGCGAAAGACGCAGAGGCAAGGGGCATGACGGTCTGTACCAGGGTCT CTCTACAGCCACCAAGGACACTTATGATGCGTTGCATATGCAAGCCTTG CCACCCCGC |
| 923 | 813 | GAGGTGCAGCTGCTGGAGAGCGGTGGAGGGTTGGTGCAGCCCGGGGGTA GCCTGCGTCTGTCGTGCGCCGCTTCCGGCTTCACGTTCTCTGATTACGC CATGCACTGGTTCCGGCAGGCCCCCGGTAAGGAGCGCGTGCTGGTGTCG TCTATTGACTCCGGCGGCTCCACTTACTACGCAGACAGTGTCAAGGGCC GTTTCACCATCAGCCGCGACAACAGCAAGAACACGCTGTACCTGCAGAT GAACTCCCTTCGAGCAGAGGACACCGCGGTGTACTACTGTAATGCGGGC TTCAAGGGCGATCACCCCCACCCCAAGGATGCCTTCGACATTTGGGGCC AGGGCACCCAGGTCACCGTGTCGTCCACCACAACACCTGCTCCAAGGCC CCCCACACCCGCTCCAACTATAGCCAGCCAACCATTGAGCCTCAGACCT GAAGCTTGCAGGCCCGCAGCAGGAGGCGCCGTCCATACGCGAGGCCTGG ACTTCGCGTGTGATATTTATATTTGGGCACCTTTGGCCGGAACATGTGG GGTGTTGCTTCTCTCCCTTGTGATCACTCTGTATTGTAAGCGCGGGAGA AAGAAGCTCCTGTACATCTTCAAGCAGCCTTTTATGCGACCTGTGCAAA CCACTCAGGAAGAAGATGGGTGTTCATGCCGCTTCCCCGAGGAGGAAGA AGGAGGGTGTGAACTGAGGGTGAAATTTTCTAGAAGCGCCGATGCTCCC GCATATCAGCAGGGTCAGAATCAGCTCTACAATGAATTGAATCTCGGCA GGCGAGAAGAGTACGATGTTCTGGACAAAAGACGGGGCAGGGATCCCGA GATGGGGGGAAAGCCCCGGAGAAAAAATCCTCAGGAGGGGTTGTACAAT GAGCTGCAGAAGGACAAGATGGCTGAAGCCTATAGCGAGATCGGAATGA AAGGCGAAAGACGCAGAGGCAAGGGGCATGACGGTCTGTACCAGGGTCT CTCTACAGCCACCAAGGACACTTATGATGCGTTGCATATGCAAGCCTTG CCACCCCGC |
| 924 | 837 | GAGGTGCAACTGCTGGAATCCGGCGGAGGCCTGGTGCAGCCCGGCGGCA GCCTCAGACTGAGCTGTGCCGCTTCTGGCTTTACCTTCAGCAGCGAGGG CATGAGCTGGGTGCGGCAGGCCCCTGGCAAGGAAAGAGAGCTGGTCTCC GCCATCAGCGGATCTGGCGACCACACCTACTATGCCGATAGCGTGCGCG GAAGATTCACAATCTCTAGAGATAATAGCAAGAACACCCTGTACCTGCA GATGAACAGCCTGCGGGCCGAGGACACCGCCGTGTACTACTGCAACGCC CTGGAAGGCGGCCCTACAACAGCTATCCAGCCAGGAGGCCCTGACTACT GGGGCCAGGGCACCCAGGTGACCGTGTCCAGCACCACAACACCTGCTCC AAGGCCCCCCACACCCGCTCCAACTATAGCCAGCCAACCATTGAGCCTC AGACCTGAAGCTTGCAGGCCCGCAGCAGGAGGCGCCGTCCATACGCGAG GCCTGGACTTCGCGTGTGATATTTATATTTGGGCACCTTTGGCCGGAAC ATGTGGGGTGTTGCTTCTCTCCCTTGTGATCACTCTGTATTGTAAGCGC GGGAGAAAGAAGCTCCTGTACATCTTCAAGCAGCCTTTTATGCGACCTG TGCAAACCACTCAGGAAGAAGATGGGTGTTCATGCCGCTTCCCCGAGGA GGAAGAAGGAGGGTGTGAACTGAGGGTGAAATTTTCTAGAAGCGCCGAT GCTCCCGCATATCAGCAGGGTCAGAATCAGCTCTACAATGAATTGAATC TCGGCAGGCGAGAAGAGTACGATGTTCTGGACAAAAGACGGGGCAGGGA TCCCGAGATGGGGGGAAAGCCCCGGAGAAAAAATCCTCAGGAGGGGTTG TACAATGAGCTGCAGAAGGACAAGATGGCTGAAGCCTATAGCGAGATCG GAATGAAAGGCGAAAGACGCAGAGGCAAGGGGCATGACGGTCTGTACCA GGGTCTCTCTACAGCCACCAAGGACACTTATGATGCGTTGCATATGCAA GCCTTGCCACCCCGC |
| 925 | 861 + 189 | ATGGCTCTTCCCGTAACAGCCCTTTTGTTGCCCCTTGCACTCCTTCTGC ATGCAGCACGACCGGAGATCGTGCTGACACAGTCTCCCGCCACACTGTC ACTGTCTCCAGGCGAAAGAGCCACACTGAGCTGTAGAGCCAGCCAGAGC GTGTCCTCTTACCTGGCCTGGTATCAGCAGAAGCCTGGACAGGCTCCCC GGCTGCTGATCTACGATGCCAGCAATAGAGCCACAGGCATCCCCGCCAG ATTTCTGGCAGCGGCTCTGGCACCGATTTCACCCTGACCATAAGCAGC CTGGAACCTGAGGACTTCGCCGTGTACTACTGCCAGCAGAGAGTGGTGT ACCCCATCACCTTTGGCGGAGGCACCAAGGTGGAAATCAAAGGCGGCGG AGGAAGCGGAGGCGGAGGATCTGGTGGTGGTGGATCTGGCGGAGGTGGC AGCCAGATCACACTGAAAGAGTCTGGCCCCACACTGGTCAAGCCCACAC AGACCCTGACACTGACCTGCACCTTCAGCGGCTTTAGCCTGAGCACATC TGGCGTCGGCGTTGGCTGGATTAGACAGCCTCCTGGAAAGGCCCTGGAA |

TABLE 9-continued

| SEQ ID NO. | AA SEQ ID NO. | NUCLEIC ACID SEQUENCE |
|---|---|---|
| | | TGGCTGGCCCTGATCTACTGGAACGACGAGAAGAGATACAGCCCCAGCC<br>TGAAGTCCCGGCTGACCATCACCAAGGACACCAGCAAGAACCAGGTGGT<br>GCTGACCATGACAAACATGGACCCCGTGGACACCGCCGTGTATTATTGC<br>GCCAGAGATGAGTACGGCGGCTTCGACATTTGGGGCCAGGGCACAATGG<br>TCACCGTGTCTAGTACCACAACACCTGCTCCAAGGCCCCCCACACCCGC<br>TCCAACTATAGCCAGCCAACCATTGAGCCTCAGACCTGAAGCTTGCAGG<br>CCCGCAGCAGGAGGCGCCGTCCATACGCGAGGCCTGGACTTCGCGTGTG<br>ATATTTATATTTGGGCACCTTTGGCCGGAACATGTGGGGTGTTGCTTCT<br>CTCCCTTGTGATCACTCTGTATTGTAAGCGCGGGAGAAAGAAGCTCCTG<br>TACATCTTCAAGCAGCCTTTTATGCGACCTGTGCAAACCACTCAGGAAG<br>AAGATGGGTGTTCATGCCGCTTCCCCGAGGAGGAAGAAGGAGGGTGTGA<br>ACTGAGGGTGAAATTTTCTAGAAGCGCCGATGCTCCCGCATATCAGCAG<br>GGTCAGAATCAGCTCTACAATGAATTGAATCTCGGCAGGCGAGAAGAGT<br>ACGATGTTCTGGACAAAAGACGGGGCAGGGATCCCGAGATGGGGGGAAA<br>GCCCCGGAGAAAAAATCCTCAGGAGGGGTTGTACAATGAGCTGCAGAAG<br>GACAAGATGGCTGAAGCCTATAGCGAGATCGGAATGAAAGGCGAAAGAC<br>GCAGAGGCAAGGGGCATGACGGTCTGTACCAGGGTCTCTCTACAGCCAC<br>CAAGGACACTTATGATGCGTTGCATATGCAAGCCTTGCCACCCCGC |
| 926 | 861 + 237 | ATGGCTCTTCCCGTAACAGCCCTTTTGTTGCCCCTTGCACTCCTTCTGC<br>ATGCAGCACGACCGGAGATCGTGCTGACCCAGTCCCCTGCTACCCTGAG<br>CCTGTCTCCAGGCGAGCGGGCCACACTGAGCTGTAGAGCTTCTCAGAGC<br>GTGTCCAGCTACCTGGCCTGGTATCAGCAGAAACCTGGCCAGGCCCCTA<br>GACTGCTGATCTACGACGCCAGCAACCGGGCCACCGGCATCCCCGCCAG<br>ATTCAGCGGATCTGGCAGCGGCACAGATTTTACCCTCACCATCAGCAGC<br>CTGGAACCTGAGGACTTCGCCGTCTACTACTGCCAGCAAAGATTCGACT<br>ACCCCATCACCTTCGGCGGCGGAACAAAGGTGGAAATTAAGGGTGGTGG<br>GGGCAGCGGTGGAGGTGGGAGCGGAGGCGGGGGTAGCGGAGGCGGGGGT<br>AGCCAAATCACACTGAAAGAGAGCGGCCCTACACTCGTGAAACCTACCC<br>AGACCCTGACACTGACATGTACCTTCAGCGGCTTCTCCCTGAGCACCTC<br>TGGCGTCGGCGTTGGATGGATCAGACAGCCTCCAGGCAAGGCCCTGGAA<br>TGGCTGGCTCTGATCTATTGGAACGACGACAAGCGGTACAGCCCCAGCC<br>TGAAGTCTAGACTGACCATCACAAAGGACACCAGCAAGAACCAGGTGGT<br>GCTGACCATGACAAATATGGACCCCGTGGACACCGCCGTGTACTACTGC<br>GCCAGAGATGAGTACGGCGGATTTGATATCTGGGGCCAGGGCACCATGG<br>TGACCGTGTCCAGCACCACAACACCTGCTCCAAGGCCCCCCACACCCGC<br>TCCAACTATAGCCAGCCAACCATTGAGCCTCAGACCTGAAGCTTGCAGG<br>CCCGCAGCAGGAGGCGCCGTCCATACGCGAGGCCTGGACTTCGCGTGTG<br>ATATTTATATTTGGGCACCTTTGGCCGGAACATGTGGGGTGTTGCTTCT<br>CTCCCTTGTGATCACTCTGTATTGTAAGCGCGGGAGAAAGAAGCTCCTG<br>TACATCTTCAAGCAGCCTTTTATGCGACCTGTGCAAACCACTCAGGAAG<br>AAGATGGGTGTTCATGCCGCTTCCCCGAGGAGGAAGAAGGAGGGTGTGA<br>ACTGAGGGTGAAATTTTCTAGAAGCGCCGATGCTCCCGCATATCAGCAG<br>GGTCAGAATCAGCTCTACAATGAATTGAATCTCGGCAGGCGAGAAGAGT<br>ACGATGTTCTGGACAAAAGACGGGGCAGGGATCCCGAGATGGGGGGAAA<br>GCCCCGGAGAAAAAATCCTCAGGAGGGGTTGTACAATGAGCTGCAGAAG<br>GACAAGATGGCTGAAGCCTATAGCGAGATCGGAATGAAAGGCGAAAGAC<br>GCAGAGGCAAGGGGCATGACGGTCTGTACCAGGGTCTCTCTACAGCCAC<br>CAAGGACACTTATGATGCGTTGCATATGCAAGCCTTGCCACCCCGC |
| 927 | 861 + 261 | ATGGCTCTTCCCGTAACAGCCCTTTTGTTGCCCCTTGCACTCCTTCTGC<br>ATGCAGCACGACCGCAAGTGCAGCTCGTGGAAAGCGGCGGCGGAGTGGT<br>GCAGCCCGGCCGGAGCCTGAGACTGTCCTGCGCCGCTTCTGGATTTACC<br>TTCAGCAGCTACGGCATGCACTGGGTCAGACAGGCCCCTGGCAAAGGCC<br>TGGAGTGGGTGGCCGTTATCAGCTACGAGGGCAGCAACAAGTATTACGC<br>CGACAGCGTGAAGGGCCGCTTCACAATCTCTAGAGATAATAGCAAGAAC<br>ACCCTGTACCTGCAGATGAACAGCCTGCGGGCCGAAGATACCGCCGTGT<br>ACTACTGTGCTAGAGAGCTGGGCGACGGCATGGACGTGTGGGGACAGGG<br>CACAACCGTGACCGTGTCCTCTGGTGGTGGGGGCAGCGGTGGAGGTGGG<br>AGCGGAGGCGGGGGTAGCGGAGGCGGGGGTAGCGAGATCGTGCTGACCC<br>AGTCCCCTGCTACACTGAGCCTGTCTCCAGGCGAGCGGGCCACACTGAG<br>CTGTAGAGCTTCTCAGAGCGTGTCCAGCTATCTGGCCTGGTTCCAGCAG<br>AAACCTGGCCAGGCCCCTAGACTGCTGATCTACGACGCCAGCAACCGGG<br>CCACCGGCATCCCCGCCAGATTCAGCGGCTCTGGCAGCGGCACCGACTT<br>CACCCTCACCATCAGCAGCCTGGAACCCGAGGATTTTGCCGTCTACTAC<br>TGCCAGCAAAGAGTGGACCTGTGGACCTTCGGCGGAGGAACAAAGGTGG<br>AAATCAAGACCACAACACCTGCTCCAAGGCCCCCCACACCCGCTCCAAC<br>TATAGCCAGCCAACCATTGAGCCTCAGACCTGAAGCTTGCAGGCCCGCA<br>GCAGGAGGCGCCGTCCATACGCGAGGCCTGGACTTCGCGTGTGATATTT<br>ATATTTGGGCACCTTTGGCCGGAACATGTGGGGTGTTGCTTCTCTCCCT<br>TGTGATCACTCTGTATTGTAAGCGCGGGAGAAAGAAGCTCCTGTACATC<br>TTCAAGCAGCCTTTTATGCGACCTGTGCAAACCACTCAGGAAGAAGATG<br>GGTGTTCATGCCGCTTCCCCGAGGAGGAAGAAGGAGGGTGTGAACTGAG<br>GGTGAAATTTTCTAGAAGCGCCGATGCTCCCGCATATCAGCAGGGTCAG<br>AATCAGCTCTACAATGAATTGAATCTCGGCAGGCGAGAAGAGTACGATG<br>TTCTGGACAAAAGACGGGGCAGGGATCCCGAGATGGGGGGAAAGCCCCG<br>GAGAAAAAATCCTCAGGAGGGGTTGTACAATGAGCTGCAGAAGGACAAG |

TABLE 9-continued

| SEQ ID NO. | AA SEQ ID NO. | NUCLEIC ACID SEQUENCE |
|---|---|---|
| | | ATGGCTGAAGCCTATAGCGAGATCGGAATGAAAGGCGAAAGACGCAGAG<br>GCAAGGGGCATGACGGTCTGTACCAGGGTCTCTCTACAGCCACCAAGGA<br>CACTTATGATGCGTTGCATATGCAAGCCTTGCCACCCCGC |
| 928 | 861 + 333 | ATGGCTCTTCCCGTAACAGCCCTTTTGTTGCCCCTTGCACTCCTTCTGC<br>ATGCAGCACGACCGGACATCCAGATGACCCAGAGCCCTTCGACCCTATC<br>CGCTTCCGTGGGTGACCGTGTGACCATCACCTGTCGCGCGTCGCAGAGC<br>ATCTCCTCCTGGCTCGCGTGGTACCAACAGAAGCCTGGCAAGGCCCCCA<br>AGCTGCTGATTTACGACGCCAGTTCCCTGGAGTCTGGCGTGCCATCCCG<br>CTTCTCCGGCAGCGGCAGCGGTACCGAGTTCACCCTGACGATCAGCTCC<br>CTGCAGCCGGATGACTTTGCTACCTACTACTGTCAGCAGGTCTCCTCCC<br>TCCCCCCCACCTTCGGTGGCGGTACCAAGGTGGAGATCAAGGGCGGCGG<br>CGGCTCTGGTGGCGGAGGTTCTGGCGGGGGAGGTTCGGGGGGGGGAGGC<br>TCCGAGGTGCAACTGGTAGAGAGCGGCGGGGGACTGGTAAAACCCGGCG<br>GCTCCCTGCGGCTGTCATGCGCTGCTAGCGGCTTCACGTTCAGCGATTA<br>CTACATGAGTTGGATCCGCCAGGCCCCCGGGAAGGGTTTGGAGTGGGTC<br>TCGTATATCTCTTCCAGCGGATCTACCATTTACTATGCGGACAGCGTGA<br>AGGGGCGCTTCACCATATCTCGGGACAACGCCAAGAACTCCCTGTACCT<br>GCAGATGAATTCCCTGCGTGCCGAGGACACGGCCGTGTATTACTGTGCC<br>CGCGACCAGGGCAACTACGGCGTCGACGTGTGGGGCCAGGGTACAACCG<br>TCACCGTGTCCAGTACCACAACACCTGCTCCAAGGCCCCCCACACCCGC<br>TCCAACTATAGCCAGCCAACCATTGAGCCTCAGACCTGAAGCTTGCAGG<br>CCCGCAGCAGGAGGCGCCGTCCATACGCGAGGCCTGGACTTCGCGTGTG<br>ATATTTATATTTGGGCACCTTTGGCCGGAACATGTGGGGTGTTGCTTCT<br>CTCCCTTGTGATCACTCTGTATTGTAAGCGCGGGAGAAAGAAGCTCCTG<br>TACATCTTCAAGCAGCCTTTTATGCGACCTGTGCAAACCACTCAGGAAG<br>AAGATGGGTGTTCATGCCGCTTCCCCGAGGAGGAAGAAGGAGGGTGTGA<br>ACTGAGGGTGAAATTTTCTAGAAGCGCCGATGCTCCCGCATATCAGCAG<br>GGTCAGAATCAGCTCTACAATGAATTGAATCTCGGCAGGCGAGAAGAGT<br>ACGATGTTCTGGACAAAAGACGGGGCAGGGATCCCGAGATGGGGGGAAA<br>GCCCCGGAGAAAAAATCCTCAGGAGGGGTTGTACAATGAGCTGCAGAAG<br>GACAAGATGGCTGAAGCCTATAGCGAGATCGGAATGAAAGGCGAAAGAC<br>GCAGAGGCAAGGGGCATGACGGTCTGTACCAGGGTCTCTCTACAGCCAC<br>CAAGGACACTTATGATGCGTTGCATATGCAAGCCTTGCCACCCCGC |
| 929 | 861 + 357 | ATGGCTCTTCCCGTAACAGCCCTTTTGTTGCCCCTTGCACTCCTTCTGC<br>ATGCAGCACGACCGCAAGTGCAGCTGGTCGAGAGCGGAGGAGGCCTGGT<br>TAAGCCCGGCGGATCTCTCAGACTGAGCTGCGCCGCTAGCGGCTTTACA<br>TTCAGCGACTACTACATGAGCTGGATCCGGCAGGCCCCTGGCAAGGGCC<br>TGGAATGGGTGTCCTACATCAGCTCCTCCGGCAGCACCATCTACTACGC<br>CGACAGCGTGAAAGGCAGATTCACAATCTCTAGAGATAATGCCAAGAAC<br>AGCCTGTACCTGCAGATGAACAGCCTGCGGGCCGAGGACACCGCCGTGT<br>ACTATTGTGCTAGAGATCAGGGCAACTACGGCGTGGACGTGTGGGGCCA<br>GGGCACCACCGTGACCGTGTCTAGCGGTGGTGGGGGCAGCGGTGGAGGT<br>GGGAGCGGAGGCGGGGGTAGCGGAGGCGGGGGTAGCGATATCCAGATGA<br>CCCAGTCCCCATCTACACTGAGCGCCTCTGTGGGCGACCGGGTGACCAT<br>TACATGTAGAGCCAGCCAGAGCATCAGCAGCTGGCTGGCTTGGTATCAG<br>CAGAAACCTGGCAAGGCCCCTAAGCTGCTGATCTACGAGGCCAGCAGCC<br>TGGAAAGCGGCGTCCCCAGCAGATTCAGCGGCAGCGGCTCTGGAACAGA<br>GTTCACCCTGACCATCTCCTCCCTGCAGCCTGACGACTTCGCCACCTAC<br>TACTGCCAGCAATCTGATAGCCACCCCATCACCTTTGGCGGAGGCACCA<br>AGGTGGAAATCAAGACCACAACACCTGCTCCAAGGCCCCCCACACCCGC<br>TCCAACTATAGCCAGCCAACCATTGAGCCTCAGACCTGAAGCTTGCAGG<br>CCCGCAGCAGGAGGCGCCGTCCATACGCGAGGCCTGGACTTCGCGTGTG<br>ATATTTATATTTGGGCACCTTTGGCCGGAACATGTGGGGTGTTGCTTCT<br>CTCCCTTGTGATCACTCTGTATTGTAAGCGCGGGAGAAAGAAGCTCCTG<br>TACATCTTCAAGCAGCCTTTTATGCGACCTGTGCAAACCACTCAGGAAG<br>AAGATGGGTGTTCATGCCGCTTCCCCGAGGAGGAAGAAGGAGGGTGTGA<br>ACTGAGGGTGAAATTTTCTAGAAGCGCCGATGCTCCCGCATATCAGCAG<br>GGTCAGAATCAGCTCTACAATGAATTGAATCTCGGCAGGCGAGAAGAGT<br>ACGATGTTCTGGACAAAAGACGGGGCAGGGATCCCGAGATGGGGGGAAA<br>GCCCCGGAGAAAAAATCCTCAGGAGGGGTTGTACAATGAGCTGCAGAAG<br>GACAAGATGGCTGAAGCCTATAGCGAGATCGGAATGAAAGGCGAAAGAC<br>GCAGAGGCAAGGGGCATGACGGTCTGTACCAGGGTCTCTCTACAGCCAC<br>CAAGGACACTTATGATGCGTTGCATATGCAAGCCTTGCCACCCCGC |
| 930 | 861 + 429 | ATGGCTCTTCCCGTAACAGCCCTTTTGTTGCCCCTTGCACTCCTTCTGC<br>ATGCAGCACGACCGGATATCCAGATGACCCAGTCCCCATCTACACTGAG<br>CGCCTCTGTGGGCGACCGGGTGACAATTACCTGTAGAGCTAGCCAGAGC<br>ATCTCCTCCTGGCTGGCTTGGTACCAGCAAAAACCTGGCAAGGCCCCTA<br>AGCTGCTGATCTACGAGGCCAGCAGCCTGGAAAGCGGCGTCCCCTCTAG<br>ATTCAGCGGCAGCGGCTCTGGAACCGAGTTCACCCTGACAATCAGCAGC<br>CTGCAGCCTGACGACTTCGCCACCTATTACTGCCAGCAGGCCAACAGCC<br>ACCCCATCACCTTTGGCGGAGGCACCAAGGTGGAAATCAAGGGTGGTGG<br>GGGCAGCGGTGGAGGTGGGAGCGGAGGCGGGGGTAGCGGAGGCGGGGGT<br>AGCGAGGTGCAGCTGGTGGAAAGCGGCGGAGGACTCGTTAAGCCCGGCG<br>GCAGCCTGAGACTGAGCTGCGCCGCTAGCGGATTTACCTTCAGCGACTA |

TABLE 9-continued

| SEQ ID NO. | AA SEQ ID NO. | NUCLEIC ACID SEQUENCE |
|---|---|---|
| | | CTACATGAGCTGGATCCGGCAGGCCCCTGGCAAGGGCCTGGAATGGGTC AGCTACATCAGCTCCTCTGGCTCTACAATCTACTACGCCGACAGCGTGA AAGGCAGATTCACCATCTCTAGAGATAATGCCAAGAACAGCCTGTACCT GCAAATGAACAGCCTGCGGGCCGAGGACACCGCCGTGTACTATTGTGCT AGAGATCAGGGCAACTACGGCGTGGACGTGTGGGGCCAGGGCACCACCG TGACAGTGTCCTCCACCACAACACCTGCTCCAAGGCCCCCCACACCCGC TCCAACTATAGCCAGCCAACCATTGAGCCTCAGACCTGAAGCTTGCAGG CCCGCAGCAGGAGGCGCCGTCCATACGCGAGGCCTGGACTTCGCGTGTG ATATTTATATTTGGGCACCTTTGGCCGGAACATGTGGGGTGTTGCTTCT CTCCCTTGTGATCACTCTGTATTGTAAGCGCGGGAGAAAGAAGCTCCTG TACATCTTCAAGCAGCCTTTTATGCGACCTGTGCAAACCACTCAGGAAG AAGATGGGTGTTCATGCCGCTTCCCCGAGGAGGAAGAAGGAGGGTGTGA ACTGAGGGTGAAATTTTCTAGAAGCGCCGATGCTCCCGCATATCAGCAG GGTCAGAATCAGCTCTACAATGAATTGAATCTCGGCAGGCGAGAAGAGT ACGATGTTCTGGACAAAAGACGGGGCAGGGATCCCGAGATGGGGGGAAA GCCCCGGAGAAAAAATCCTCAGGAGGGGTTGTACAATGAGCTGCAGAAG GACAAGATGGCTGAAGCCTATAGCGAGATCGGAATGAAAGGCGAAAGAC GCAGAGGCAAGGGGCATGACGGTCTGTACCAGGGTCTCTCTACAGCCAC CAAGGACACTTATGATGCGTTGCATATGCAAGCCTTGCCACCCCGC |
| 931 | 861 + 477 | ATGGCTCTTCCCGTAACAGCCCTTTTGTTGCCCCTTGCACTCCTTCTGC ATGCAGCACGACCGGACATCCAGATGACCCAGAGCCCTAGCTCCCTGAG CGCCAGCGTGGGCGATAGAGTGACCATTACCTGTAGAGCCTCTCAGAGC ATCTCCTCCTACCTGAACTGGTATCAGCAGAAACCCGGCAAGGCCCCTA AGCTGCTGATCTACGCCGCTAGCAGCCTGCAGTCTGGCGTCCCCAGCCG GTTCAGCGGCAGCGGATCTGGCACCGACTTCACCCTGACAATCAGCAGC CTGCAACCTGAGGACTTTGCTACATACTACTGCCAGCAGGCCCACAGCT CTCCAATCACCTTCGGCGGCGGAACAAAGGTGGAAATCAAGGGTGGTGG GGGCAGCGGTGGAGGTGGGAGCGGAGGCGGGGGTAGCGGAGGCGGGGGT AGCGAGGTGCAGCTGCTGGAAAGCGGAGGCGGACTCGTTCAACCTGGCG GCAGCCTGAGACTGAGCTGCGCCGCTTCTGGATTTACCTTCAGCAACTA CGCCATGAGCTGGGTGCGGCAGGCCCCTGGCAAAGGCCTGGAATGGGTC TCCGCCATCAGCGGCTCTGGCGGCTCCACCTACTACGCCGACAGCGTGA AGGGCAGATTCACCATCTCTAGAGATAATAGCAAGAACACCCTGTACCT GCAGATGAACAGCCTGCGGGCCGAGGACACCGCCGTGTACTATTGTGCT AGACCCGGAGATGGCTACTACGAGGGCGTGTACTTCGACTACTGGGGCC AGGGCACACTGGTGACAGTGTCCAGCACCACAACACCTGCTCCAAGGCC CCCCACACCCGCTCCAACTATAGCCAGCCAACCATTGAGCCTCAGACCT GAAGCTTGCAGGCCCGCAGCAGGAGGCGCCGTCCATACGCGAGGCCTGG ACTTCGCGTGTGATATTTATATTTGGGCACCTTTGGCCGGAACATGTGG GGTGTTGCTTCTCTCCCTTGTGATCACTCTGTATTGTAAGCGCGGGAGA AAGAAGCTCCTGTACATCTTCAAGCAGCCTTTTATGCGACCTGTGCAAA CCACTCAGGAAGAAGATGGGTGTTCATGCCGCTTCCCCGAGGAGGAAGA AGGAGGGTGTGAACTGAGGGTGAAATTTTCTAGAAGCGCCGATGCTCCC GCATATCAGCAGGGTCAGAATCAGCTCTACAATGAATTGAATCTCGGCA GGCGAGAAGAGTACGATGTTCTGGACAAAAGACGGGGCAGGGATCCCGA GATGGGGGGAAAGCCCCGGAGAAAAAATCCTCAGGAGGGGTTGTACAAT GAGCTGCAGAAGGACAAGATGGCTGAAGCCTATAGCGAGATCGGAATGA AAGGCGAAAGACGCAGAGGCAAGGGGCATGACGGTCTGTACCAGGGTCT CTCTACAGCCACCAAGGACACTTATGATGCGTTGCATATGCAAGCCTTG CCACCCCGC |
| 932 | 861 + 525 | ATGGCTCTTCCCGTAACAGCCCTTTTGTTGCCCCTTGCACTCCTTCTGC ATGCAGCACGACCGGATATTCAGATGACCCAGAGCCCATCTAGCCTGAG CGCCAGCGTGGGCGATAGAGTGACCATCACCTGTCAGGCCTCTCAGGAC ATCGCTAATTACCTGAACTGGTATCAGCAGAAACCCGGCAAGGCCCCTA AGCTGCTGATCTACGACGCCTCCAACCTGGAAACCGGCGTGCCCAGCCG GTTCAGCGGCAGCGGATCTGGCACAGACTTCACCTTTACCATCAGCTCC CTCCAGCCTGAGGACATCGCCACATACTACTGCCAGCAACACTTCAACC TGCCTCTGACCTTCGGCGGCGGAACAAAGGTCGAGATCAAGGGTGGTGG GGGCAGCGGTGGAGGTGGGAGCGGAGGCGGGGGTAGCGGAGGCGGGGGT AGCCAAATCACCCTGAAAGAGAGCGGACCTACACTGGTCAAGCCTACCC AGACACTGACCCTCACATGTACATTCAGCGGCTTTAGCCTGAGCACCTC CGGCGTGGGAGTGGGCTGGATCAGACAGCCCCCCGGCAAGGCCCTGGAA TGGCTGGCTCTGATCTATTGGAATGACGAGAAGCGGTACAGCCCTAGCC TGAAATCTAGACTGACAATCACCAAGGACACCAGCAAGAACCAGGTGGT GCTGACCATGACCAACATGGATCCTGTGGATACCGCCGTGTACTACTGC GCCAGAGAAGGCTCTCACGACTACAAGAGCTCCAACTGGTTCGACCCAT GGGGCCAGGGCACCCTGGTTACAGTGTCTAGCACCACAACACCTGCTCC AAGGCCCCCCACACCCGCTCCAACTATAGCCAGCCAACCATTGAGCCTC AGACCTGAAGCTTGCAGGCCCGCAGCAGGAGGCGCCGTCCATACGCGAG GCCTGGACTTCGCGTGTGATATTTATATTTGGGCACCTTTGGCCGGAAC ATGTGGGGTGTTGCTTCTCTCCCTTGTGATCACTCTGTATTGTAAGCGC GGGAGAAAGAAGCTCCTGTACATCTTCAAGCAGCCTTTTATGCGACCTG TGCAAACCACTCAGGAAGAAGATGGGTGTTCATGCCGCTTCCCCGAGGA GGAAGAAGGAGGGTGTGAACTGAGGGTGAAATTTTCTAGAAGCGCCGAT GCTCCCGCATATCAGCAGGGTCAGAATCAGCTCTACAATGAATTGAATC |

TABLE 9-continued

| SEQ ID NO. | AA SEQ ID NO. | NUCLEIC ACID SEQUENCE |
|---|---|---|
| | | TCGGCAGGCGAGAAGAGTACGATGTTCTGGACAAAAGACGGGGCAGGGA TCCCGAGATGGGGGGAAAGCCCCGGAGAAAAAATCCTCAGGAGGGGTTG TACAATGAGCTGCAGAAGGACAAGATGGCTGAAGCCTATAGCGAGATCG GAATGAAAGGCGAAAGACGCAGAGGCAAGGGGCATGACGGTCTGTACCA GGGTCTCTCTACAGCCACCAAGGACACTTATGATGCGTTGCATATGCAA GCCTTGCCACCCCGC |
| 933 | 861 + 573 | ATGGCTCTTCCCGTAACAGCCCTTTTGTTGCCCCTTGCACTCCTTCTGC ATGCAGCACGACCGGATATCGTGATGACCCAATCTCCACTGAGCCTGCC TGTGACACCTGGCGAGCCTGCTTCTATCAGCTGTAGAAGCAGCCAGTCC CTGCTGCACAGCAACGGCTACAACTACCTGGACTGGTATCTGCAGAAAC CCGGCCAGAGCCCCCAGCTGCTGATCTACCTCGGCTCTAATCGGGCCAG CGGAGTGCCTGATAGATTCAGCGGAAGCGGCTCCGGCACCGACTTCACC CTGAAGATCAGCAGAGTGGAAGCCGAGGACGTGGGCGTCTACTACTGCA TGCAGGCCCTGGGCCTGATTACATTTGGCGGCGGAACCAAGGTGGAAAT CAAGGGTGGTGGGGGCAGCGGTGGAGGTGGGAGCGGAGGCGGGGGTAGC GGAGGCGGGGGTAGCGAAGTGCAGCTGGTTGAGAGCGGCGGCGGACTGG TGAAGCCCGGAGGCAGCCTCAGACTGAGCTGTGCTGCTTCTGGCTTTAC CTTCAGCTCTTATAGCATGAACTGGGTGCGGCAGGCCCCTGGCAAGGGC CTGGAATGGGTCAGCTCCATCAGCTCTTCTAGCAGCTACATCTACTACG CCGACAGCGTGAAGGGCAGATTCACCATCAGCAGAGATAACGCCAAGAA CAGCCTGTACCTGCAGATGAATAGCCTGCGGGCCGAGGACACCGCCGTG TACTACTGCGCCAGAGCCGGCGACACCTACAGCGCCGCCGATTACTACT ACATGGACGTGTGGGGCAAAGGAACAACCGTGACAGTGTCCTCCACCAC AACACCTGCTCCAAGGCCCCCCACACCCGCTCCAACTATAGCCAGCCAA CCATTGAGCCTCAGACCTGAAGCTTGCAGGCCCGCAGCAGGAGGCGCCG TCCATACGCGAGGCCTGGACTTCGCGTGTGATATTTATATTTGGGCACC TTTGGCCGGAACATGTGGGGTGTTGCTTCTCTCCCTTGTGATCACTCTG TATTGTAAGCGCGGGAGAAAGAAGCTCCTGTACATCTTCAAGCAGCCTT TTATGCGACCTGTGCAAACCACTCAGGAAGAAGATGGGTGTTCATGCCG CTTCCCCGAGGAGGAAGAAGGAGGGTGTGAACTGAGGGTGAAATTTTCT AGAAGCGCCGATGCTCCCGCATATCAGCAGGGTCAGAATCAGCTCTACA ATGAATTGAATCTCGGCAGGCGAGAAGAGTACGATGTTCTGGACAAAAG ACGGGGCAGGGATCCCGAGATGGGGGGAAAGCCCCGGAGAAAAAATCCT CAGGAGGGGTTGTACAATGAGCTGCAGAAGGACAAGATGGCTGAAGCCT ATAGCGAGATCGGAATGAAAGGCGAAAGACGCAGAGGCAAGGGGCATGA CGGTCTGTACCAGGGTCTCTCTACAGCCACCAAGGACACTTATGATGCG TTGCATATGCAAGCCTTGCCACCCCGC |
| 934 | 861 + 597 | ATGGCTCTTCCCGTAACAGCCCTTTTGTTGCCCCTTGCACTCCTTCTGC ATGCAGCACGACCGGAAGTGCAACTGCTGGAAAGCGGCGGAGGCCTGGT CCAGCCCGGCGGCTCTCTGCGGCTCAGCTGCGCCGCTTCTGGATTTACC TTCGGCAGCGAGGCTATGAGCTGGGTGCGGCAGGCCCCTGGAAAAGAGA GAGAGCTGGTGTCCGCCATCAGCGGCAGCGGCGAGGTGACCTACTACGC CGACAGCGTGAAGGGCAGATTCACCATCTCTAGAGATAATAGCAAGAAC ACCCTGTACCTGCAGATGAACAGCCTGAGAGCCGAGGACACCGCCGTGT ACTATTGTCAGAGACTGGTGGAAGCCAAGCGGCACTGGGGCCAGGGCAC ACAGGTTACAGTGTCCAGCACCACAACACCTGCTCCAAGGCCCCCCACA CCCGCTCCAACTATAGCCAGCCAACCATTGAGCCTCAGACCTGAAGCTT GCAGGCCCGCAGCAGGAGGCGCCGTCCATACGCGAGGCCTGGACTTCGC GTGTGATATTTATATTTGGGCACCTTTGGCCGGAACATGTGGGGTGTTG CTTCTCTCCCTTGTGATCACTCTGTATTGTAAGCGCGGGAGAAAGAAGC TCCTGTACATCTTCAAGCAGCCTTTTATGCGACCTGTGCAAACCACTCA GGAAGAAGATGGGTGTTCATGCCGCTTCCCCGAGGAGGAAGAAGGAGGG TGTGAACTGAGGGTGAAATTTTCTAGAAGCGCCGATGCTCCCGCATATC AGCAGGGTCAGAATCAGCTCTACAATGAATTGAATCTCGGCAGGCGAGA AGAGTACGATGTTCTGGACAAAAGACGGGGCAGGGATCCCGAGATGGGG GGAAAGCCCCGGAGAAAAAATCCTCAGGAGGGGTTGTACAATGAGCTGC AGAAGGACAAGATGGCTGAAGCCTATAGCGAGATCGGAATGAAAGGCGA AAGACGCAGAGGCAAGGGGCATGACGGTCTGTACCAGGGTCTCTCTACA GCCACCAAGGACACTTATGATGCGTTGCATATGCAAGCCTTGCCACCCC GC |
| 935 | 861 + 621 | ATGGCTCTTCCCGTAACAGCCCTTTTGTTGCCCCTTGCACTCCTTCTGC ATGCAGCACGACCGGAAGTGCAACTGCTGGAATCTGGCGGAGGACTGGT GCAGCCCGGCGGCAGCCTGCGGCTGAGCTGTGCTGCTTCTGGCTTTACC TTCGAGTCTGAGGCCATGAGCTGGTATAGACAGGCCCCTGGCAAGGAAA GAGAGCTGGTCAGCGTGATCACCAGCGAGGGCTCCACCTACTACGCCGA CAGCGTGAAAGGCAGATTCACAATCAGCCGGGACAATAGCAAGAACACC CTGTACCTGCAGATGAACAGCCTGCGCGCCGAAGATACAGCCGTGTACT ACTGCGCCCACATCGAGTGGGAGACAAGACTCAACTGGGGCCAGGGCAC CCAGGTGACCGTGTCCAGCACCACAACACCTGCTCCAAGGCCCCCCACA CCCGCTCCAACTATAGCCAGCCAACCATTGAGCCTCAGACCTGAAGCTT GCAGGCCCGCAGCAGGAGGCGCCGTCCATACGCGAGGCCTGGACTTCGC GTGTGATATTTATATTTGGGCACCTTTGGCCGGAACATGTGGGGTGTTG CTTCTCTCCCTTGTGATCACTCTGTATTGTAAGCGCGGGAGAAAGAAGC TCCTGTACATCTTCAAGCAGCCTTTTATGCGACCTGTGCAAACCACTCA |

TABLE 9-continued

| SEQ ID NO. | AA SEQ ID NO. | NUCLEIC ACID SEQUENCE |
|---|---|---|
| | | GGAAGAAGATGGGTGTTCATGCCGCTTCCCCGAGGAGGAAGAAGGAGGG<br>TGTGAACTGAGGGTGAAATTTTCTAGAAGCGCCGATGCTCCCGCATATC<br>AGCAGGGTCAGAATCAGCTCTACAATGAATTGAATCTCGGCAGGCGAGA<br>AGAGTACGATGTTCTGGACAAAAGACGGGGCAGGGATCCCGAGATGGGG<br>GGAAAGCCCCGGAGAAAAAATCCTCAGGAGGGGTTGTACAATGAGCTGC<br>AGAAGGACAAGATGGCTGAAGCCTATAGCGAGATCGGAATGAAAGGCGA<br>AAGACGCAGAGGCAAGGGGCATGACGGTCTGTACCAGGGTCTCTCTACA<br>GCCACCAAGGACACTTATGATGCGTTGCATATGCAAGCCTTGCCACCCC<br>GC |
| 936 | 861 + 645 | ATGGCTCTTCCCGTAACAGCCCTTTTGTTGCCCCTTGCACTCCTTCTGC<br>ATGCAGCACGACCGGAGGTGCAGCTGCTGGAAAGCGGAGGGGGCCTGGT<br>CCAACCCGGCGGGTCTCTTCGCCTAAGCTGTGCCGCTTCTGGCTTCACC<br>TTCGACGAGTACACCATGCACTGGTTCAGACAGGCCCCCGGCAAGGAGC<br>GCGAGTTCGTCAGTGCAATCAGCGGAGGCGGTAGCGAGACTTATTACGC<br>GGACTCCGTGAAGGGCCGCTTCACCATTAGCCGCGACAACTCCAAGAAC<br>ACGCTGTACCTGCAGATGAATTCGCTGCGCGCCGAAGATACGGCCGTGT<br>ACTACTGTGCCGCTGGTGGGGAGGAGGCTGGCGTGGGCTATTGGGGCCA<br>GGGCACCCAGGTCACCGTGTCGTCCACCACAACACCTGCTCCAAGGCCC<br>CCCACACCCGCTCCAACTATAGCCAGCCAACCATTGAGCCTCAGACCTG<br>AAGCTTGCAGGCCCGCAGCAGGAGGCGCCGTCCATACGCGAGGCCTGGA<br>CTTCGCGTGTGATATTTATATTTGGGCACCTTTGGCCGGAACATGTGGG<br>GTGTTGCTTCTCTCCCTTGTGATCACTCTGTATTGTAAGCGCGGGAGAA<br>AGAAGCTCCTGTACATCTTCAAGCAGCCTTTTATGCGACCTGTGCAAAC<br>CACTCAGGAAGAAGATGGGTGTTCATGCCGCTTCCCCGAGGAGGAAGAA<br>GGAGGGTGTGAACTGAGGGTGAAATTTTCTAGAAGCGCCGATGCTCCCG<br>CATATCAGCAGGGTCAGAATCAGCTCTACAATGAATTGAATCTCGGCAG<br>GCGAGAAGAGTACGATGTTCTGGACAAAAGACGGGGCAGGGATCCCGAG<br>ATGGGGGGAAAGCCCCGGAGAAAAAATCCTCAGGAGGGGTTGTACAATG<br>AGCTGCAGAAGGACAAGATGGCTGAAGCCTATAGCGAGATCGGAATGAA<br>AGGCGAAAGACGCAGAGGCAAGGGGCATGACGGTCTGTACCAGGGTCTC<br>TCTACAGCCACCAAGGACACTTATGATGCGTTGCATATGCAAGCCTTGC<br>CACCCCGC |
| 937 | 861 + 669 | ATGGCTCTTCCCGTAACAGCCCTTTTGTTGCCCCTTGCACTCCTTCTGC<br>ATGCAGCACGACCGGAGGTGCAGCTGCTGGAGAGCGGAGGCGGCCTCGT<br>GCAGCCAGGAGGTTCCCTACGACTCTCCTGTGCCGCCAGCGGCTTCACC<br>TTCGAGGACTACGCCATGAGTTGGTTCCGCCAGGCCCCGGGGAAGGAGC<br>GCGAGGGCGTGAGCGCGATTTCTGGAAAGGGCGGCTCCACCTATTACGC<br>GGACTCCGTGAAGGGTCGCTTTACCATCTCTCGCGACAACTCCAAGAAC<br>ACGCTGTACCTGCAGATGAATAGCCTGCGCGCTGAGGACACTGCCGTGT<br>ACTACTGTGCTGTCTTGGACGAGGAGGCCGGCGCAGAGGGCGGCTATTG<br>GGGCCAGGGTACCCAGGTCACCGTGTCGTCCACCACAACACCTGCTCCA<br>AGGCCCCCCACACCCGCTCCAACTATAGCCAGCCAACCATTGAGCCTCA<br>GACCTGAAGCTTGCAGGCCCGCAGCAGGAGGCGCCGTCCATACGCGAGG<br>CCTGGACTTCGCGTGTGATATTTATATTTGGGCACCTTTGGCCGGAACA<br>TGTGGGGTGTTGCTTCTCTCCCTTGTGATCACTCTGTATTGTAAGCGCG<br>GGAGAAAGAAGCTCCTGTACATCTTCAAGCAGCCTTTTATGCGACCTGT<br>GCAAACCACTCAGGAAGAAGATGGGTGTTCATGCCGCTTCCCCGAGGAG<br>GAAGAAGGAGGGTGTGAACTGAGGGTGAAATTTTCTAGAAGCGCCGATG<br>CTCCCGCATATCAGCAGGGTCAGAATCAGCTCTACAATGAATTGAATCT<br>CGGCAGGCGAGAAGAGTACGATGTTCTGGACAAAAGACGGGGCAGGGAT<br>CCCGAGATGGGGGGAAAGCCCCGGAGAAAAAATCCTCAGGAGGGGTTGT<br>ACAATGAGCTGCAGAAGGACAAGATGGCTGAAGCCTATAGCGAGATCGG<br>AATGAAAGGCGAAAGACGCAGAGGCAAGGGGCATGACGGTCTGTACCAG<br>GGTCTCTCTACAGCCACCAAGGACACTTATGATGCGTTGCATATGCAAG<br>CCTTGCCACCCCGC |
| 938 | 861 + 693 | ATGGCTCTTCCCGTAACAGCCCTTTTGTTGCCCCTTGCACTCCTTCTGC<br>ATGCAGCACGACCGGAGGTGCAACTGCTGGAAAGCGGCGGTGGACTGGT<br>GCAGCCCGGCGGCAGCCTGAGACTGTCTTGTGCTGCTTCTGGATTTACA<br>TTCGACAGATACGCCATGAGCTGGTTCCGCCAGGCCCCTGGCAAAGAGC<br>GGGAAGGCGTGTCCGCCATCTCCACAAGCGGAGATAGCACATACTATGC<br>CGACAGCGTGAAGGGCAGATTCACCATCAGCAGAGATAATAGCAAGAAC<br>ACCCTGTACCTGCAGATGAACAGCCTCCGGGCCGAGGACACCGCCGTCT<br>ACTACTGCGCCGTGCTGGACGAGGAAGCCGGCGCCGAGGGCGGCTACTG<br>GGGCCAGGGCACCCAGGTGACCGTGTCTAGCACCACAACACCTGCTCCA<br>AGGCCCCCCACACCCGCTCCAACTATAGCCAGCCAACCATTGAGCCTCA<br>GACCTGAAGCTTGCAGGCCCGCAGCAGGAGGCGCCGTCCATACGCGAGG<br>CCTGGACTTCGCGTGTGATATTTATATTTGGGCACCTTTGGCCGGAACA<br>TGTGGGGTGTTGCTTCTCTCCCTTGTGATCACTCTGTATTGTAAGCGCG<br>GGAGAAAGAAGCTCCTGTACATCTTCAAGCAGCCTTTTATGCGACCTGT<br>GCAAACCACTCAGGAAGAAGATGGGTGTTCATGCCGCTTCCCCGAGGAG<br>GAAGAAGGAGGGTGTGAACTGAGGGTGAAATTTTCTAGAAGCGCCGATG<br>CTCCCGCATATCAGCAGGGTCAGAATCAGCTCTACAATGAATTGAATCT<br>CGGCAGGCGAGAAGAGTACGATGTTCTGGACAAAAGACGGGGCAGGGAT<br>CCCGAGATGGGGGGAAAGCCCCGGAGAAAAAATCCTCAGGAGGGGTTGT |

TABLE 9-continued

| SEQ ID NO. | AA SEQ ID NO. | NUCLEIC ACID SEQUENCE |
|---|---|---|
| | | ACAATGAGCTGCAGAAGGACAAGATGGCTGAAGCCTATAGCGAGATCGG<br>AATGAAAGGCGAAAGACGCAGAGGCAAGGGGCATGACGGTCTGTACCAG<br>GGTCTCTCTACAGCCACCAAGGACACTTATGATGCGTTGCATATGCAAG<br>CCTTGCCACCCCGC |
| 939 | 861 + 717 | ATGGCTCTTCCCGTAACAGCCCTTTTGTTGCCCCTTGCACTCCTTCTGC<br>ATGCAGCACGACCGGAGGTGCAACTGCTGGAAAGCGGCGGAGGACTCGT<br>CCAGCCCGGCGGCAGCCTGCGGCTGAGCTGTGCTGCTTCTGGATTTACC<br>TTCGCCAGCGACGCCATGAGCTGGTATAGACAGGCCCCTGGCAAAGAGC<br>GGGAACTGGTGTCCGCCATCAGCGGCTCTGGCGGCTCCACCTACTACGC<br>CGATAGCGTGAAGGGCAGATTCACAATCTCTAGAGATAATAGCAAGAAC<br>ACCCTGTACCTGCAGATGAACAGCCTGAGAGCCGAGGACACCGCCGTGT<br>ACTACTGCGCCGCTCACGACAGCGGCGAGGCCTACCTGGCCTTCGACTA<br>CTGGGGCCAGGGCACACAGGTGACCGTGTCTAGCACCACAACACCTGCT<br>CCAAGGCCCCCCACACCCGCTCCAACTATAGCCAGCCAACCATTGAGCC<br>TCAGACCTGAAGCTTGCAGGCCCGCAGCAGGAGGCGCCGTCCATACGCG<br>AGGCCTGGACTTCGCGTGTGATATTTATATTTGGGCACCTTTGGCCGGA<br>ACATGTGGGGTGTTGCTTCTCTCCCTTGTGATCACTCTGTATTGTAAGC<br>GCGGGAGAAAGAAGCTCCTGTACATCTTCAAGCAGCCTTTTATGCGACC<br>TGTGCAAACCACTCAGGAAGAAGATGGGTGTTCATGCCGCTTCCCCGAG<br>GAGGAAGAAGGAGGGTGTGAACTGAGGGTGAAATTTTCTAGAAGCGCCG<br>ATGCTCCCGCATATCAGCAGGGTCAGAATCAGCTCTACAATGAATTGAA<br>TCTCGGCAGGCGAGAAGAGTACGATGTTCTGGACAAAAGACGGGGCAGG<br>GATCCCGAGATGGGGGGAAAGCCCCGGAGAAAAAATCCTCAGGAGGGGT<br>TGTACAATGAGCTGCAGAAGGACAAGATGGCTGAAGCCTATAGCGAGAT<br>CGGAATGAAAGGCGAAAGACGCAGAGGCAAGGGGCATGACGGTCTGTAC<br>CAGGGTCTCTCTACAGCCACCAAGGACACTTATGATGCGTTGCATATGC<br>AAGCCTTGCCACCCCGC |
| 940 | 861 + 741 | ATGGCTCTTCCCGTAACAGCCCTTTTGTTGCCCCTTGCACTCCTTCTGC<br>ATGCAGCACGACCGGAGGTGCAACTGCTGGAAAGCGGCGGAGGACTCGT<br>CCAGCCCGGCGGCAGCCTGAGGCTGAGCTGTGCTGCTTCTGGCTTTACC<br>TTCGACTCCTACACAATGAGCTGGTATAGACAGGCCCCTGGCAAGGAGC<br>GGGAACTGGTGTCCGCCATCAGCGGCCACGGCGACTCTACATACTACGC<br>CGACAGCGTGAAAGGCAGATTCACAATCTCTAGAGATAATAGCAAGAAC<br>ACCCTGTACCTGCAGATGAACAGCCTGCGGGCCGAGGACACCGCCGTGT<br>ACTACTGCACCAGAATCAGCATCACCACCGAGTGGCTGGCCGGAGATTA<br>CTGGGGCCAGGGCACCCAGGTGACAGTGTCCAGCACCACAACACCTGCT<br>CCAAGGCCCCCCACACCCGCTCCAACTATAGCCAGCCAACCATTGAGCC<br>TCAGACCTGAAGCTTGCAGGCCCGCAGCAGGAGGCGCCGTCCATACGCG<br>AGGCCTGGACTTCGCGTGTGATATTTATATTTGGGCACCTTTGGCCGGA<br>ACATGTGGGGTGTTGCTTCTCTCCCTTGTGATCACTCTGTATTGTAAGC<br>GCGGGAGAAAGAAGCTCCTGTACATCTTCAAGCAGCCTTTTATGCGACC<br>TGTGCAAACCACTCAGGAAGAAGATGGGTGTTCATGCCGCTTCCCCGAG<br>GAGGAAGAAGGAGGGTGTGAACTGAGGGTGAAATTTTCTAGAAGCGCCG<br>ATGCTCCCGCATATCAGCAGGGTCAGAATCAGCTCTACAATGAATTGAA<br>TCTCGGCAGGCGAGAAGAGTACGATGTTCTGGACAAAAGACGGGGCAGG<br>GATCCCGAGATGGGGGGAAAGCCCCGGAGAAAAAATCCTCAGGAGGGGT<br>TGTACAATGAGCTGCAGAAGGACAAGATGGCTGAAGCCTATAGCGAGAT<br>CGGAATGAAAGGCGAAAGACGCAGAGGCAAGGGGCATGACGGTCTGTAC<br>CAGGGTCTCTCTACAGCCACCAAGGACACTTATGATGCGTTGCATATGC<br>AAGCCTTGCCACCCCGC |
| 941 | 861 + 765 | ATGGCTCTTCCCGTAACAGCCCTTTTGTTGCCCCTTGCACTCCTTCTGC<br>ATGCAGCACGACCGGAGGTGCAGCTGCTGGAAAGCGGAGGAGGCCTGGT<br>CCAACCTGGCGGCAGCCTGCGGCTGAGCTGCGCCGCTTCTGGCTTCACC<br>TTCAGCAGCTACGCCATGAGCTGGTTCCGGCAGGCCCCTGGCAAGGAAA<br>GAGAGTTCGTGTCTTTTATCAGCGGATCTGGCGACTCCACCTACTACGC<br>TGATAGCGTGAAAGGCAGATTTACCATCTCTAGAGATAATAGCAAGAAC<br>ACCCTGTACCTCCAGATGAACAGCCTGCGCGCCGAGGACACAGCCGTGT<br>ACTATTGTACCAGATGGCCTTACGACTTCGAGGAACCAAGCGAGCCCGG<br>CGTGTACTGGGGCCAGGGCACACAGGTGACAGTGTCCTCCACCACAACA<br>CCTGCTCCAAGGCCCCCCACACCCGCTCCAACTATAGCCAGCCAACCAT<br>TGAGCCTCAGACCTGAAGCTTGCAGGCCCGCAGCAGGAGGCGCCGTCCA<br>TACGCGAGGCCTGGACTTCGCGTGTGATATTTATATTTGGGCACCTTTG<br>GCCGGAACATGTGGGGTGTTGCTTCTCTCCCTTGTGATCACTCTGTATT<br>GTAAGCGCGGGAGAAAGAAGCTCCTGTACATCTTCAAGCAGCCTTTTAT<br>GCGACCTGTGCAAACCACTCAGGAAGAAGATGGGTGTTCATGCCGCTTC<br>CCCGAGGAGGAAGAAGGAGGGTGTGAACTGAGGGTGAAATTTTCTAGAA<br>GCGCCGATGCTCCCGCATATCAGCAGGGTCAGAATCAGCTCTACAATGA<br>ATTGAATCTCGGCAGGCGAGAAGAGTACGATGTTCTGGACAAAAGACGG<br>GGCAGGGATCCCGAGATGGGGGGAAAGCCCCGGAGAAAAAATCCTCAGG<br>AGGGGTTGTACAATGAGCTGCAGAAGGACAAGATGGCTGAAGCCTATAG<br>CGAGATCGGAATGAAAGGCGAAAGACGCAGAGGCAAGGGGCATGACGGT<br>CTGTACCAGGGTCTCTCTACAGCCACCAAGGACACTTATGATGCGTTGC<br>ATATGCAAGCCTTGCCACCCCGC |

TABLE 9-continued

| SEQ ID NO. | AA SEQ ID NO. | NUCLEIC ACID SEQUENCE |
|---|---|---|
| 942 | 861 + 789 | ATGGCTCTTCCCGTAACAGCCCTTTTGTTGCCCCTTGCACTCCTTCTGC<br>ATGCAGCACGACCGGAGGTGCAGCTGCTGGAAAGCGGCGGAGGCCTGGT<br>GCAACCTGGCGGATCTCTCAGACTGAGCTGTGCTGCTTCTGGCTTCACA<br>TTCACCGACTACGACATGAGCTGGTATAGACAGGCCCCTGGAAAAGAGC<br>GGGAACTGGTCTCCGTGATCCACAGCGGCGGCTCCACCTACTACGCCGA<br>TAGCGTGAAGGGCAGATTCACCATCAGCAGAGATAATAGCAAGAACACC<br>CTGTACCTGCAGATGAACAGCCTGCGGGCCGAGGACACCGCCGTGTACT<br>ACTGCGCCCCCGGCTACTACAGCGACCTGTCTTTTGATTATTACAACTT<br>CGACTACTGGGGCCAGGGCACACAGGTGACAGTGTCCAGCACCACAACA<br>CCTGCTCCAAGGCCCCCCACACCCGCTCCAACTATAGCCAGCCAACCAT<br>TGAGCCTCAGACCTGAAGCTTGCAGGCCCGCAGCAGGAGGCGCCGTCCA<br>TACGCGAGGCCTGGACTTCGCGTGTGATATTTATATTTGGGCACCTTTG<br>GCCGGAACATGTGGGGTGTTGCTTCTCTCCCTTGTGATCACTCTGTATT<br>GTAAGCGCGGGAGAAAGAAGCTCCTGTACATCTTCAAGCAGCCTTTTAT<br>GCGACCTGTGCAAACCACTCAGGAAGAAGATGGGTGTTCATGCCGCTTC<br>CCCGAGGAGGAAGAAGGAGGGTGTGAACTGAGGGTGAAATTTTCTAGAA<br>GCGCCGATGCTCCCGCATATCAGCAGGGTCAGAATCAGCTCTACAATGA<br>ATTGAATCTCGGCAGGCGAGAAGAGTACGATGTTCTGGACAAAAGACGG<br>GGCAGGGATCCCGAGATGGGGGGAAAGCCCCGGAGAAAAAATCCTCAGG<br>AGGGGTTGTACAATGAGCTGCAGAAGGACAAGATGGCTGAAGCCTATAG<br>CGAGATCGGAATGAAAGGCGAAAGACGCAGAGGCAAGGGGCATGACGGT<br>CTGTACCAGGGTCTCTCTACAGCCACCAAGGACACTTATGATGCGTTGC<br>ATATGCAAGCCTTGCCACCCCGC |
| 943 | 861 + 813 | ATGGCTCTTCCCGTAACAGCCCTTTTGTTGCCCCTTGCACTCCTTCTGC<br>ATGCAGCACGACCGGAGGTGCAGCTGCTGGAGAGCGGTGGAGGGTTGGT<br>GCAGCCCGGGGGTAGCCTGCGTCTGTCGTGCGCCGCTTCCGGCTTCACG<br>TTCTCTGATTACGCCATGCACTGGTTCCGGCAGGCCCCCGGTAAGGAGC<br>GCGTGCTGGTGTCGTCTATTGACTCCGGCGGCTCCACTTACTACGCAGA<br>CAGTGTCAAGGGCCGTTTCACCATCAGCCGCGACAACAGCAAGAACACG<br>CTGTACCTGCAGATGAACTCCCTTCGAGCAGAGGACACCGCGGTGTACT<br>ACTGTAATGCGGGCTTCAAGGGCGATCACCCCCACCCCAAGGATGCCTT<br>CGACATTTGGGGCCAGGGCACCCAGGTCACCGTGTCGTCCACCACAACA<br>CCTGCTCCAAGGCCCCCCACACCCGCTCCAACTATAGCCAGCCAACCAT<br>TGAGCCTCAGACCTGAAGCTTGCAGGCCCGCAGCAGGAGGCGCCGTCCA<br>TACGCGAGGCCTGGACTTCGCGTGTGATATTTATATTTGGGCACCTTTG<br>GCCGGAACATGTGGGGTGTTGCTTCTCTCCCTTGTGATCACTCTGTATT<br>GTAAGCGCGGGAGAAAGAAGCTCCTGTACATCTTCAAGCAGCCTTTTAT<br>GCGACCTGTGCAAACCACTCAGGAAGAAGATGGGTGTTCATGCCGCTTC<br>CCCGAGGAGGAAGAAGGAGGGTGTGAACTGAGGGTGAAATTTTCTAGAA<br>GCGCCGATGCTCCCGCATATCAGCAGGGTCAGAATCAGCTCTACAATGA<br>ATTGAATCTCGGCAGGCGAGAAGAGTACGATGTTCTGGACAAAAGACGG<br>GGCAGGGATCCCGAGATGGGGGGAAAGCCCCGGAGAAAAAATCCTCAGG<br>AGGGGTTGTACAATGAGCTGCAGAAGGACAAGATGGCTGAAGCCTATAG<br>CGAGATCGGAATGAAAGGCGAAAGACGCAGAGGCAAGGGGCATGACGGT<br>CTGTACCAGGGTCTCTCTACAGCCACCAAGGACACTTATGATGCGTTGC<br>ATATGCAAGCCTTGCCACCCCGC |
| 944 | 861 + 837 | ATGGCTCTTCCCGTAACAGCCCTTTTGTTGCCCCTTGCACTCCTTCTGC<br>ATGCAGCACGACCGGAGGTGCAACTGCTGGAATCCGGCGGAGGCCTGGT<br>GCAGCCCGGCGGCAGCCTCAGACTGAGCTGTGCCGCTTCTGGCTTTACC<br>TTCAGCAGCGAGGGCATGAGCTGGGTGCGGCAGGCCCCTGGCAAGGAAA<br>GAGAGCTGGTCTCCGCCATCAGCGGATCTGGCGACCACACCTACTATGC<br>CGATAGCGTGCGCGGAAGATTCACAATCTCTAGAGATAATAGCAAGAAC<br>ACCCTGTACCTGCAGATGAACAGCCTGCGGGCCGAGGACACCGCCGTGT<br>ACTACTGCAACGCCCTGGAAGGCGGCCCTACAACAGCTATCCAGCCAGG<br>AGGCCCTGACTACTGGGGCCAGGGCACCCAGGTGACCGTGTCCAGCACC<br>ACAACACCTGCTCCAAGGCCCCCCACACCCGCTCCAACTATAGCCAGCC<br>AACCATTGAGCCTCAGACCTGAAGCTTGCAGGCCCGCAGCAGGAGGCGC<br>CGTCCATACGCGAGGCCTGGACTTCGCGTGTGATATTTATATTTGGGCA<br>CCTTTGGCCGGAACATGTGGGGTGTTGCTTCTCTCCCTTGTGATCACTC<br>TGTATTGTAAGCGCGGGAGAAAGAAGCTCCTGTACATCTTCAAGCAGCC<br>TTTTATGCGACCTGTGCAAACCACTCAGGAAGAAGATGGGTGTTCATGC<br>CGCTTCCCCGAGGAGGAAGAAGGAGGGTGTGAACTGAGGGTGAAATTTT<br>CTAGAAGCGCCGATGCTCCCGCATATCAGCAGGGTCAGAATCAGCTCTA<br>CAATGAATTGAATCTCGGCAGGCGAGAAGAGTACGATGTTCTGGACAAA<br>AGACGGGGCAGGGATCCCGAGATGGGGGGAAAGCCCCGGAGAAAAAATC<br>CTCAGGAGGGGTTGTACAATGAGCTGCAGAAGGACAAGATGGCTGAAGC<br>CTATAGCGAGATCGGAATGAAAGGCGAAAGACGCAGAGGCAAGGGGCAT<br>GACGGTCTGTACCAGGGTCTCTCTACAGCCACCAAGGACACTTATGATG<br>CGTTGCATATGCAAGCCTTGCCACCCCGC |

In particular embodiments, a vector comprises a polynucleotide encoding a polypeptide contemplated herein. In particular embodiments, the polypeptide is selected from the group consisting of an antibody, an antigen binding fragment of an antibody, a bispecific antibody, a BITE, and a chimeric antigen receptor.

In particular embodiments, a vector comprises a polynucleotide that encodes a polypeptide comprising an anti-BCMA antibody or antigen binding fragment thereof comprising an amino acid sequence set forth in any one of SEQ ID NOs: 11-144.

In particular embodiments, a vector comprises a polynucleotide that encodes a bispecific antibody comprising an anti-BCMA antibody or antigen binding fragment thereof comprising an amino acid sequence set forth in any one of SEQ ID NOs: 11-144; and optionally a polypeptide linker and an anti-CD3 antibody.

In particular embodiments, a cell, e.g., an immune effector cell, is modified to express a polypeptide, e.g., a chimeric antigen receptor, that comprises an anti-BCMA antibody or antigen binding fragment thereof comprising an amino acid sequence set forth in any one of SEQ ID NOs: 11-144.

In particular embodiments, a polynucleotide contemplated herein or vector comprising or encoding the same is introduced into a cell, e.g., an immune effector cell. In particular embodiments, a non-viral vector comprising a polynucleotide is introduced into a cell. Illustrative examples non-viral vectors include but are not limited to: autonomously replicating sequences; plasmids; phagemids; cosmids; artificial chromosomes such as yeast artificial chromosomes (YAC), bacterial artificial chromosomes (BAC), or P1-derived artificial chromosomes (PAC); bacteriophages such as lambda phage or M13 phage; and transposable elements including but not limited to piggyBac, Sleeping Beauty, Mosl, Tcl/mariner, Tol2, mini-Tol2, Tc3, MuA, Himar I, Frog Prince, and derivatives thereof.

In particular embodiments, a viral vector comprising a polynucleotide is introduced into a cell. Illustrative examples of viral vectors include but are not limited to Adenoviral (Ad) vectors, adeno-associated virus (AAV) vectors, rhabdovirus (e.g., lyssavirus, vesiculovirus) vectors, paramyxovirus (e.g., henipavirus, morbillivirus, respirovirus, rubelavirus) vectors, herpes simplex virus (e.g., HSV-1, HSV-2) vectors, vaccinia virus vectors, and retroviral vectors, preferably lentiviral vectors (LVV).

A “viral vector” is a nucleic acid molecule derived from a viral genome that is used to transfer or deliver another nucleic acid to a cell. A viral vector is based on, and derived from, a virus genome that has been engineered to remove viral accessory proteins but leave elements intact for packaging, reverse transcription and integration. In preferred embodiments, viral vectors contemplated herein comprise a polynucleotide comprising or encoding a promoter operably linked to a polynucleotide encoding a polypeptide comprising an anti-BCMA binding protein, e.g., an anti-BCMA antibody or antigen binding fragment thereof, an anti-BCMA-antiCD3 bispecific antibody, or a chimeric antigen receptor (CAR).

In particular embodiments, an adenoviral vector comprises a polynucleotide comprising or encoding a promoter operably linked to a polynucleotide encoding a polypeptide comprising an anti-BCMA binding protein, e.g., an anti-BCMA antibody or antigen binding fragment thereof, an anti-BCMA-antiCD3 bispecific antibody, or a CAR. High-capacity adenoviral vectors (HC-Ads) (third generation) only retain short non-coding regions from the Ad genome (ITRs and ψ signal), which enables the vector tp carry large polynucleotide payloads (~37 kb).

In particular embodiments, an AAV vector comprises a polynucleotide comprising or encoding a promoter operably linked to a polynucleotide encoding a polypeptide comprising an anti-BCMA binding protein, e.g., an anti-BCMA antibody or antigen binding fragment thereof, an anti-BCMA-antiCD3 bispecific antibody, or a CAR. Recombinant AAV (rAAV) vectors are primarily episomally maintained and have a polynucleotide payload capacity of about 4.7 kb. rAAV vectors are typically composed of, at a minimum, a transgene and its regulatory sequences, and 5' and 3' AAV inverted terminal repeats (ITRs). rAAV vectors may comprise ITRs from any one of AAV1, AAV2, AAV3, AAV4, AAV5, AAV6, AAV7, AAV8, AAV9, or AAV10. Construction of rAAV vectors, and production, and purificationof AAV have been disclosed, e.g., in U.S. Pat. Nos. 9,169,494; 9,169,492; 9,012,224; 8,889,641; 8,809,058; and 8,784,799, each of which is incorporated by reference herein, in its entirety.

In particular embodiments, an HSV vector comprises a polynucleotide comprising or encoding a promoter operably linked to a polynucleotide encoding a polypeptide comprising an anti-BCMA binding protein, e.g., an anti-BCMA antibody or antigen binding fragment thereof, an anti-BCMA-antiCD3 bispecific antibody, or a CAR. HSV vectors are relatively large, e.g., up to 152 kb. Typically, HSV vectors are rendered replication deficient; moreover, one or more essential or non-essential HSV genes are removed from the vector backbone to make room for polynucleotide payloads. Most replication deficient HSV vectors contain a deletion to remove one or more intermediate-early, early, or late HSV genes to prevent replication. Advantages of the HSV vector are its ability to enter a latent stage that can result in long-term DNA expression and its large viral DNA genome that can accommodate exogenous DNA inserts of up to 25 kb. HSV-based vectors are described in, for example, U.S. Pat. Nos. 5,837,532, 5,846,782, and 5,804,413, and International Patent Applications WO 91/02788, WO 96/04394, WO 98/15637, and WO 99/06583, each of which are incorporated by reference herein in its entirety.

In particular embodiments, a retroviral vector or a lentiviral vector comprises a polynucleotide comprising or encoding a promoter operably linked to a polynucleotide encoding a polypeptide comprising an anti-BCMA binding protein, e.g., an anti-BCMA antibody or antigen binding fragment thereof, an anti-BCMA-antiCD3 bispecific antibody, or a CAR. In particular embodiments, a recombinant particle comprises two copies of a vector, a genomic RNA comprising backbone sequences derived from a retrovirus genome, e.g., a lentivirus genome.

In various embodiments, a retroviral vector is engineered or derived from a retrovirus genome selected from the group consisting of: an alpharetrovirus genome, a betaretrovirus genome, a gammaretrovirus genome, a deltaretrovirus genome, or a spumavirus genome (e.g., an epsilonretrovirus genome, a simiispumavirus genome, a bovispumavirus genome, an equispumavirus genome, a felispumavirus genome, and a prosimiispumavirus genome).

In particular embodiments, a retroviral vector comprises a 5' LTR and a 3' LTR each isolated, obtained, or derived from a retrovirus genome selected from the group consisting of: an alpharetrovirus genome, a betaretrovirus genome, a gammaretrovirus genome, a deltaretrovirus genome, an epsilonretrovirus genome, and a spumavirus genome.

Illustrative examples of alpharetroviruses from which a retroviral vector may be isolated, obtained, or derived from include but are not limited to avian leukosis virus, avian carcinoma Mill Hill virus 2, avian myeloblastosis virus, avian myelocytomatosis virus 29, avian sarcoma virus CT10, fujinami sarcoma virus, rous sarcoma virus, UR2 sarcoma virus and Y73 sarcoma virus.

Illustrative examples of betaretroviruses from which a retroviral vector may be isolated, obtained, or derived from include but are not limited to mouse mammary tumor virus, Jaagsiekte sheep retrovirus, langur virus, Mason-Pfizer monkey virus, and squirrel monkey retrovirus (SMRV).

Illustrative examples of deltaretroviruses from which a retroviral vector may be isolated, obtained, or derived from include but are not limited to bovine leukemia virus, primate T-lymphotropic virus 1, primate T-lymphotropic virus 2, primate T-lymphotropic virus 3, and primate T-lymphotropic virus 4.

Illustrative examples of epsilonretroviruses from which a retroviral vector may be isolated, obtained, or derived from include but are not limited to walleye dermal sarcoma virus, walleye epidermal hyperplasia virus 1, and walleye epidermal hyperplasia virus 2.

Illustrative examples of gammaretrovirus from which a retroviral vector may be isolated, obtained, or derived from include but are not limited to baboon endogenous virus (BaEV), chick syncytial virus, feline endogenous virus (e.g., RD114), feline leukemia virus (FeLV), Finkel-Biskis-Jinkins murine sarcoma virus, Gardner-Arnstein feline sarcoma virus, gibbon ape leukemia virus (GALV), guinea pig type-C oncovirus, Hardy-Zuckerman feline sarcoma virus, Harvey murine sarcoma virus, Kirsten murine sarcoma virus, koala retrovirus, murine leukemia virus (MLV), Moloney murine leukemia virus (MoMLV), Moloney murine sarcoma virus, porcine endogenous virus (PERV), Porcine type-C oncovirus, reticuloendotheliosis virus (REV), Snyder-Theilen feline sarcoma virus, Trager duck spleen necrosis virus, viper retrovirus, xenotropic murine leukemia virus-related virus (XMRV), and woolly monkey sarcoma virus.

Illustrative examples of spumaviruses from which a retroviral vector may be isolated, obtained, or derived from include but are not limited to simian foamy virus, bovine foamy virus, equine foamy virus, feline foamy virus, human foamy virus (HFV), and brown greater galago prosimian foamy virus.

In various embodiments, a lentiviral vector (lentivector) is engineered or derived from a lentivirus genome. Illustrative lentiviruses include, but are not limited to, HIV (human immunodeficiency virus; including HIV type 1, and HIV type 2); visna-maedi virus (VMV); caprine arthritis-encephalitis virus (CAEV); equine infectious anemia virus (EIAV); feline immunodeficiency virus (FIV); bovine immune deficiency virus (BIV); and simian immunodeficiency virus (SIV). In particular embodiments, lentiviral vectors are derived from HIV viral genomes, preferably HIV-1 or HIV-2 viral genomes and more preferably, HIV-1 viral genomes (i.e., HIV-1 cis-acting sequence elements are preferred).

In various embodiments, a lentivirus comprises two copies of a lentiviral vector-based RNA genome comprising a 5' long terminal repeat (LTR) comprising R and U5 regions; a Psi (I) packaging signal; a cPPT/FLAP, an export element; a polynucleotide comprising or encoding a promoter operably linked to a polynucleotide encoding a polypeptide comprising an anti-BCMA binding protein, e.g., an anti-BCMA antibody or antigen binding fragment thereof, an anti-BCMA-antiCD3 bispecific antibody, or a CAR; a 3' LTR comprising U3 and R regions; optionally a WPRE or HPRE; a polyadenylation signal and a poly(A) tail.

The term "long terminal repeat (LTR)," as used herein, refers to elements located at the ends of retroviral polynucleotides which, in their natural sequence context, are direct repeats and contain U3, R and U5 regions. LTRs generally provide functions fundamental to the expression of retroviral genes (e.g., promotion, initiation and polyadenylation of gene transcripts) and to viral replication. The LTR contains numerous regulatory signals including transcriptional control elements, polyadenylation signals and sequences needed for replication and integration of the viral genome. The viral LTR is divided into three regions called U3, R and U5. The U3 region contains the enhancer and promoter elements. The U5 region is the sequence between the primer binding site and the R region and contains the polyadenylation signal. The R (repeat) region is flanked by the U3 and U5 regions. A transfer plasmid, which is used to package a vector genome comprises a 5' LTR comprising U3, R and/or U5 regions and a 3' LTR comprising U3, R and/or U5 regions. Adjacent to the 5' LTR are sequences necessary for reverse transcription of the genome (the tRNA primer binding site) and for efficient packaging of viral RNA into particles (the Psi "Ψ" site). A retroviral vector-based genome packaged in a particle comprises a 5' LTR comprising R and U5 regions and a 3' LTR comprising U3 and R regions. The retroviral vector-based genome is reverse transcribed and integrated into the host cell genome as a provector. Through reverse transcription and second strand synthesis of the retroviral vector genome, provectors comprise two copies of the 3' LTR, one copy that replaces the 5' LTR and the 3' LTR.

A "TAR" element as used herein, refers to the "trans-activation response" genetic element located in the R region of lentiviral vector LTRs. This element interacts with the lentiviral trans-activator (tat) genetic element to enhance lentiviral vector genome replication. In third generation lentiviral vectors, this element is not usually present because lentiviral vector transfer vectors comprise a 5' LTR U3 region replaced by a heterologous promoter.

An "R region," as used herein, refers to the region within LTRs beginning at the start of the capping group (i.e., the start of transcription) and ending immediately prior to the start of the polyA tract. The R region is also defined as being flanked by the U3 and U5 regions. The R region plays a role during reverse transcription in permitting the transfer of nascent DNA from one end of the genome to the other.

As used herein, a "packaging signal" or "packaging sequence" refers to sequences located within the retroviral genome which are required for insertion of the viral RNA into the viral capsid or particle, see e.g., Clever et al., 1995. J. of Virology, Vol. 69, No. 4; pp. 2101-2109. Several retroviral vectors use the minimal packaging signal (also referred to as the psi [Ψ] or [Ψ+] sequence) needed for encapsidation of the viral genome. Thus, as used herein, the terms "packaging sequence," "packaging signal," "psi" and the symbol "Ψ," are used in reference to the non-coding sequence required for encapsidation of retroviral RNA strands during viral particle formation.

A "FLAP element" or "cPPT/FLAP," as used herein refers to a nucleic acid whose sequence includes the central polypurine tract and central termination sequences (cPPT and CTS) of a lentivirus, e.g., HIV-1 or HIV-2. "FLAP element" and "cPPT/FLAP" may used interchangeably to refer to the foregoing FLAP element. Suitable FLAP elements are described in U.S. Pat. No. 6,682,907 and in Zennou, et al., 2000, Cell, 101:173. During HIV-1 reverse transcription, central initiation of the plus-strand DNA at the central polypurine tract (cPPT) and central termination at the central termination sequence (CTS) lead to the formation of a three-stranded DNA structure: the HIV-1 central DNA flap. While not wishing to be bound by any particular theory, the DNA flap may act as a cis-active determinant of lentiviral genome nuclear import and/or may increase virus titer.

As used herein, an "export element" refers to a cis-acting post-transcriptional regulatory element which regulates the transport of an RNA transcript from the nucleus to the cytoplasm of a cell. Examples of RNA export elements include, but are not limited to, the human immunodeficiency virus (HIV) rev response element (RRE) (see e.g., Cullen et al., 1991. J. Virol. 65:1053; and Cullen et al., 1991. Cell 58:423), the woodchuck hepatitis virus posttranscriptional regulatory element (WPRE), and the hepatitis B virus post-transcriptional regulatory element (HPRE).

Expression of heterologous sequences in viral vectors may be increased by incorporating posttranscriptional regulatory elements, efficient polyadenylation signals, and optionally, transcription termination signals into the vectors. A variety of posttranscriptional regulatory elements can increase expression of a heterologous nucleic acid at the protein, e.g., WPRE, HPRE.

Lentiviral vectors may contain one or more safety enhancements to reduce the risk of replication, insertional mutagenesis, and off-target transduction and/or expression. In particular embodiments, a lentiviral vector comprises one or more or the following safety enhancements: one or more modifications of the 5' and 3' LTRs, cell or tissue specific expression control sequences, e.g., promoters, enhancers, miRNA target sequences. A "modified LTR," as used herein, refers to one or more nucleotide additions, deletions or substitutions in the native HIV-1 5' LTR and/or 3' LTR. The skilled artisan would be able to determine whether an LTR is modified by comparison to a reference LTR.

"Self-inactivating" (SIN) vectors, as used herein, refer to replication-defective vectors, e.g., retroviral or lentiviral vectors, in which the right (3') LTR enhancer-promoter region, known as the U3 region, has been modified (e.g., by deletion or substitution) to prevent viral transcription beyond the first round of viral replication. Self-inactivation is achieved through a deletion in the U3 region of the 3' LTR of the lentiviral vector transfer plasmid that removes the LTR TATA box (e.g., deletions from −418 to −18), without significant reductions in titers.

An additional safety enhancement is provided by replacing the U3 region of the 5' LTR with a heterologous promoter to drive transcription of the viral genome during production of recombinant viral particles. Examples of heterologous promoters which can be used include, for example, viral simian virus 40 (SV40) (e.g., early or late), cytomegalovirus (CMV) (e.g., immediate early), Moloney murine leukemia virus (MoMLV), Rous sarcoma virus (RSV), and herpes simplex virus (HSV) (thymidine kinase) promoters.

In particular embodiments, a lentiviral vector is engineered to integrate into the host cell genome.

In certain embodiments, a lentiviral vector is engineered to be integration defective, episomal, and not integrate in the cell genome. As used herein, the term "integration defective lentivirus" or "IDLV" refers to a lentivirus having an integrase that lacks the capacity to integrate the viral vector into the host cell genome. Integration-incompetent viral vectors have been described in patent application WO 2006/010834, which is herein incorporated by reference in its entirety. Illustrative mutations in HIV-1 integrase suitable to reduce integrase activity include, but are not limited to: H12N, H12C, H16C, H16V, S81R, D41A, K42A, H51A, Q53C, D55V, D64E, D64V, E69A, K71A, E85A, E87A, D116N, D116I, D116A, N120G, N120I, N120E, E152G, E152A, K156E, K156A, E157A, K159E, K159A, K160A, R166A, D167A, E170A, H171A, K173A, K186Q, K186T, K188T, E198A, R199C, R199T, R199A, D202A, K211A, Q214L, Q216L, Q221L, W235F, W235E, K236S, K236A, K246A, G247W, D253A, R262A, R263A and K264H. In particular embodiments, an HIV-1 integration deficient integrase comprises a D64V, D161I, D116A, E152G, or E152A mutation; D64V, D116A, and E152G mutations; D64V, D116A, and E152A mutations; or a D64V mutation.

H. Cells

In particular embodiments, a polynucleotide encoding a polypeptide contemplated herein is introduced into a cell, e.g., an immune effector cell. In particular embodiments, a cell, e.g., an immune effector cell, is modified to express a polypeptide that comprises an anti-BCMA binding protein an anti-BCMA binding protein, e.g., an anti-BCMA antibody or antigen binding fragment thereof, an anti-BCMA-antiCD3 bispecific antibody, or a CAR.

In particular embodiments, a cell, e.g., an immune effector cell, is modified to express a polypeptide contemplated that comprises an anti-BCMA binding protein, e.g., an anti-BCMA antibody or antigen binding fragment thereof, an anti-BCMA-antiCD3 bispecific antibody, or a CAR comprising an amino acid sequence set forth in any one of SEQ ID NOs: 11-144 or a CAR comprising the amino acid sequence set forth in any one of SEQ ID NOs: 165-860.

An "immune effector cell" is any cell of the immune system that has one or more effector functions (e.g., cytotoxic cell killing activity, secretion of cytokines, induction of ADCC and/or CDC). Illustrative types of immune effector cells contemplated in particular embodiments include, without limitation, T lymphocytes, dendritic cells (DC), Treg cells, natural killer (NK) cells, natural killer T (NKT) cells, and macrophages. The terms "T cell" or "T lymphocyte" are art-recognized and are intended, in particular embodiments, to include thymocytes, immature T lymphocytes, mature T lymphocytes, resting T lymphocytes, and/or activated T lymphocytes. Illustrative examples of T lymphocytes suitable for use in particular embodiments, include but not limited to cytotoxic T cells (CTLs; $CD8^+$ T cells), TILs, helper T cells (HTLs; $CD4^+$ T cells), $CD4^+CD8^+$ T cells, $CD4^-CD8^-$ T cells, or any other subset of T cells that has an effector function. In a particular embodiment, the cells comprise $\alpha\beta$ T cells. In a particular embodiment, the cells comprise $\gamma\delta$ T cells.

In particular embodiments, immune effector cells include natural killer (NK) cells. NK cells do not express T cell antigen receptors (TCR), CD3 or surface immunoglobulins (Ig) B cell receptor, but usually express the surface markers CD16 (FcγRIII) and CD56 in humans.

In particular embodiments, immune effector cells include natural killer T (NKT) cells.

In particular embodiments, a polynucleotide encoding a polypeptide contemplated herein is introduced into a progenitor of an immune effector cell that is subsequently induced to differentiate, or differentiates, into one or more immune effector cells. In particular embodiments, progenitors of immune effectors cells include hematopoietic stem cells (HSCs) contained within the $CD34^+$ population of cells derived from cord blood, bone marrow or mobilized peripheral blood which naturally differentiate into mature immune effector cells, or which can be induced to differentiate into mature immune effector cells.

I. Compositions and Formulations

Compositions contemplated herein comprise one or more antibodies or antigen binding fragments thereof, bispecific antibodies, antibody conjugates, polypeptides, fusion polypeptides, chimeric antigen receptors, polynucleotides, vectors, and/or immune effector cells modified ex vivo.

In particular embodiments, a composition comprises one or more polynucleotides and/or polypeptides.

In particular embodiments, a composition comprises a polynucleotide comprising or encoding a promoter operably linked to one or more polynucleotide encoding one or more anti-BCMA binding proteins, e.g., an anti-BCMA antibody or antigen binding fragment thereof, an anti-BCMA-antiCD3 bispecific antibody, or a CAR.

In particular embodiments, a composition comprises a vector comprising a polynucleotide comprising or encoding a promoter operably linked to a polynucleotide encoding the amino acid sequence set forth in any one of SEQ ID NOs: 165-860 or a polynucleotide sequence set forth in any one of SEQ ID NOs: 905-944.

In particular embodiments, a composition is a pharmaceutical composition. A "pharmaceutical composition" refers to a composition formulated in a pharmaceutically-acceptable or physiologically-acceptable solution for administration to a cell or a subject, either alone, or in combination with one or more other modalities of therapy.

"Pharmaceutically acceptable" refers to molecular entities and compositions that do not produce excessive toxicity, irritation, allergic response, or other problems or complications, commensurate with a reasonable benefit/risk ratio when administered to a human.

In particular embodiments, a composition comprises a pharmaceutically acceptable carrier and a recombinant particle contemplated herein. The term "pharmaceutically acceptable carrier" refers to a diluent, adjuvant, excipient, vehicle and the like with which a polypeptide, a polynucleotide or a vector is physiologically compatible with administration to a human, including but not limited to pharmaceutically acceptable cell culture media, Dulbecco's phosphate buffered saline (PBS), Ringer's solution, 5% dextrose in water (D5W), and normal/physiologic saline (0.9% NaCl).

In particular embodiments, a composition comprises a polypeptide, a polynucleotide or a vector and a pharmaceutically acceptable carrier suitable for enteral or parenteral, e.g., intravascular (intravenous or intraarterial), intraosseous, intraperitoneal, intraventricular, intracerebral, intracranial, intraspinal, intrathecal, intramuscular, and intramedullary, administration and formulation.

In particular embodiments, a composition is substantially free of *mycoplasma*, endotoxin, and microbial contamination. By "substantially free" with respect to endotoxin is meant that there is less endotoxin per dose of cells than is allowed by the FDA for a biologic, which is a total endotoxin of 5 EU/kg body weight per day, which for an average 70 kg person is 350 EU per total dose of cells. In particular embodiments, compositions contemplated herein contain about 0.5 EU/mL to about 5.0 EU/mL, or about 0.5 EU/mL, 1.0 EU/mL, 1.5 EU/mL, 2.0 EU/mL, 2.5 EU/mL, 3.0 EU/mL, 3.5 EU/mL, 4.0 EU/mL, 4.5 EU/mL, or 5.0 EU/mL.

In particular embodiments, compositions contemplated herein are used in the treatment of a cancer, GVHD, an infectious disease, an autoimmune disease, an inflammatory disease, or an immunodeficiency. In particular embodiments, a composition comprises a recombinant particle contemplated herein and one or more cytokines, growth factors, steroids, NSAIDs, DMARDs, anti-inflammatories, chemotherapeutics, radiotherapeutics, therapeutic antibodies, or other active and ancillary agents, either alone or in combination.

It would be understood by the skilled artisan that particular embodiments contemplated herein may comprise other formulations, such as those that are well known in the pharmaceutical art, and are described, for example, in Remington: The Science and Practice of Pharmacy, Volume I and Volume II. 23rd Edition. Edited by Adeboye Adejare. Academic Press, 2020, which is incorporated by reference herein, in its entirety.

J. Enumerated Embodiments

Embodiment 1: An antibody or antigen binding fragment thereof comprising:

(a) a heavy chain variable region (VH) comprising a CDRH1, a CDRH2, and a CDRH3 of an antibody or antigen binding fragment thereof set forth in Table 1; a polypeptide linker; and a light chain variable region (VL) comprising a CDRL1, a CDRL2, and a CDRL3 of an antibody or antigen binding fragment thereof set forth in Table 1; or (b) a VHH domain comprising a CDRH1, a CDRH2, and a CDRH3 of an antibody or antigen binding fragment thereof set forth in Table 1.

Embodiment 2: The antibody or antigen binding fragment thereof of embodiment 1, wherein:

(a) the VH comprises a CDRH1, a CDRH2, and a CDRH3 comprising the amino acid sequences set forth in SEQ ID NOs: 12, 13, and 14 and the VL comprises a CDRL1, a CDRL2, and a CDRL3 comprising the amino acid sequences set forth in SEQ ID NOs: 16, 17, and 18;

(b) the VH comprises a CDRH1, a CDRH2, and a CDRH3 comprising the amino acid sequences set forth in SEQ ID NOs: 22, 23, and 24 and the VL comprises a CDRL1, a CDRL2, and a CDRL3 comprising the amino acid sequences set forth in SEQ ID NOs: 26, 27, and 28;

(c) the VH comprises a CDRH1, a CDRH2, and a CDRH3 comprising the amino acid sequences set forth in SEQ ID NOs: 32, 33, and 34 and the VL comprises a CDRL1, a CDRL2, and a CDRL3 comprising the amino acid sequences set forth in SEQ ID NOs: 36, 37, and 38;

(d) the VH comprises a CDRH1, a CDRH2, and a CDRH3 comprising the amino acid sequences set forth in SEQ ID NOs: 42, 43, and 44 and the VL comprises a CDRL1, a CDRL2, and a CDRL3 comprising the amino acid sequences set forth in SEQ ID NOs: 46, 47, and 48;

(e) the VH comprises a CDRH1, a CDRH2, and a CDRH3 comprising the amino acid sequences set forth in SEQ ID NOs: 52, 53, and 54 and the VL comprises a CDRL1, a CDRL2, and a CDRL3 comprising the amino acid sequences set forth in SEQ ID NOs: 56, 57, and 58;

(f) the VH comprises a CDRH1, a CDRH2, and a CDRH3 comprising the amino acid sequences set forth in SEQ ID NOs: 62, 63, and 64 and the VL comprises a CDRL1, a CDRL2, and a CDRL3 comprising the amino acid sequences set forth in SEQ ID NOs: 66, 67, and 68;

(g) the VH comprises a CDRH1, a CDRH2, and a CDRH3 comprising the amino acid sequences set forth in SEQ ID NOs: 72, 73, and 74 and the VL comprises a CDRL1, a CDRL2, and a CDRL3 comprising the amino acid sequences set forth in SEQ ID NOs: 76, 77, and 78;

(h) the VH comprises a CDRH1, a CDRH2, and a CDRH3 comprising the amino acid sequences set forth in SEQ ID NOs: 82, 83, and 84 and the VL comprises a CDRL1, a CDRL2, and a CDRL3 comprising the amino acid sequences set forth in SEQ ID NOs: 86, 87, and 88;

(i) the VH comprises a CDRH1, a CDRH2, and a CDRH3 comprising the amino acid sequences set forth in SEQ ID NOs: 92, 93, and 94 and the VL comprises a CDRL1, a CDRL2, and a CDRL3 comprising the amino acid sequences set forth in SEQ ID NOs: 96, 97, and 98;

(j) the VHH domain comprises a CDRH1, a CDRH2, and a CDRH3 comprising the amino acid sequences set forth in SEQ ID NOs: 102, 103, and 104;

(k) the VHH domain comprises a CDRH1, a CDRH2, and a CDRH3 comprising the amino acid sequences set forth in SEQ ID NOs: 106, 107, and 108;

(l) the VHH domain comprises a CDRH1, a CDRH2, and a CDRH3 comprising the amino acid sequences set forth in SEQ ID NOs: 110, 111, and 112;

(m) the VHH domain comprises a CDRH1, a CDRH2, and a CDRH3 comprising the amino acid sequences set forth in SEQ ID NOs: 114, 115, and 116;

(n) the VHH domain comprises a CDRH1, a CDRH2, and a CDRH3 comprising the amino acid sequences set forth in SEQ ID NOs: 118, 119, and 120;

(o) the VHH domain comprises a CDRH1, a CDRH2, and a CDRH3 comprising the amino acid sequences set forth in SEQ ID NOs: 122, 123, and 124;

(p) the VHH domain comprises a CDRH1, a CDRH2, and a CDRH3 comprising the amino acid sequences set forth in SEQ ID NOs: 126, 127, and 128;

(q) the VHH domain comprises a CDRH1, a CDRH2, and a CDRH3 comprising the amino acid sequences set forth in SEQ ID NOs: 130, 131, and 132;

(r) the VHH domain comprises a CDRH1, a CDRH2, and a CDRH3 comprising the amino acid sequences set forth in SEQ ID NOs: 134, 135, and 136;

(s) the VHH domain comprises a CDRH1, a CDRH2, and a CDRH3 comprising the amino acid sequences set forth in SEQ ID NOs: 138, 139, and 140; or (t) the VHH domain comprises a CDRH1, a CDRH2, and a CDRH3 comprising the amino acid sequences set forth in SEQ ID NOs: 142, 143, and 144.

Embodiment 3: The antibody or antigen binding fragment thereof of embodiment 1 or embodiment 2, wherein:

(a) the VH comprises the amino acid sequence set forth in SEQ ID NO: 11 and the VL comprises the amino acid sequence set forth in SEQ ID NO: 15;

(b) the VH comprises the amino acid sequence set forth in SEQ ID NO: 21 and the VL comprises the amino acid sequence set forth in SEQ ID NO: 25;

(c) the VH comprises the amino acid sequence set forth in SEQ ID NO: 31 and the VL comprises the amino acid sequence set forth in SEQ ID NO: 35;

(d) the VH comprises the amino acid sequence set forth in SEQ ID NO: 41 and the VL comprises the amino acid sequence set forth in SEQ ID NO: 45;

(e) the VH comprises the amino acid sequence set forth in SEQ ID NO: 51 and the VL comprises the amino acid sequence set forth in SEQ ID NO: 55;

(f) the VH comprises the amino acid sequence set forth in SEQ ID NO: 61 and the VL comprises the amino acid sequence set forth in SEQ ID NO: 65;

(g) the VH comprises the amino acid sequence set forth in SEQ ID NO: 71 and the VL comprises the amino acid sequence set forth in SEQ ID NO: 75;

(h) the VH comprises the amino acid sequence set forth in SEQ ID NO: 81 and the VL comprises the amino acid sequence set forth in SEQ ID NO: 85;

(i) the VH comprises the amino acid sequence set forth in SEQ ID NO: 91 and the VL comprises the amino acid sequence set forth in SEQ ID NO: 95; or (a) the VHH domain comprises the amino acid sequence set forth in any one of SEQ ID NOs: 101, 105, 109, 113, 117, 121, 125, 129, 133, 137, and 141.

Embodiment 4: The antibody or antigen binding fragment thereof of any one of embodiments 1 to 3, wherein the polypeptide linker is selected from the group consisting of: TGEKP (SEQ ID NO: 2); $(GGGGS)_n$ wherein n=1, 2, 3, 4 or 5 (SEQ ID NOs: 3 and 976-979); EGKSSGSGSESKVD (SEQ ID NO: 4); KESGSVSSEQLAQFRSLD (SEQ ID NO: 5); LRQRDGERP (SEQ ID NO: 6); LRQKDGGGSERP (SEQ ID NO: 7); LRQKD (GGGS) 2ERP (SEQ ID NO: 8), GEGTSTGSGGSGGSGGAD (SEQ ID NO: 9), and GSTSGSGKPGSGEGSTKG (SEQ ID NO: 10) and variants thereof comprising an amino acid sequence 95% identical thereto.

Embodiment 5: The antibody or antigen binding fragment thereof of any one of embodiments 1 to 4, wherein the antibody or antigen binding fragment thereof comprises the amino acid sequence set forth in any one of SEQ ID NOs: 19, 20, 29, 30, 39, 40, 49, 50, 59, 60, 69, 70, 79, 80, 89, 90, 99, 100, 101, 105, 109, 113, 117, 121, 125, 129, 133, 137, and 141.

Embodiment 6: A bispecific antibody comprising the antibody or antigen binding fragment thereof of any one of embodiments 1 to 5.

Embodiment 7: The bispecific antibody of embodiment 6, further comprising an anti-CD3 antibody that binds CD3δ, CD3ε, CD3γ, or CD3ζ.

Embodiment 8: An antibody conjugate comprising the antibody or antigen binding fragment thereof of any one of embodiments 1 to 5.

Embodiment 9: The antibody conjugate of embodiment 8, wherein the antigen or antigen binding fragment thereof is conjugated to a cytotoxic agent.

Embodiment 10: The antibody conjugate of embodiment 8 or embodiment 9, wherein:

(a) the cytotoxic agent is a toxin selected from the group consisting of: saporin, diphtheria toxin, *pseudomonas* exotoxin A, Ricin A chain derivatives, a small molecule toxin, and combinations thereof;

(b) the cytotoxic agent is a radioisotope selected from the group consisting of: 1311, 90Y, 177Lu, 188Re, 67Cu, 213Bi, 211At, and 227Ac;

(c) the cytotoxic agent is an RNA polymerase II inhibitor and/or RNA polymerase III inhibitor selected from the group consisting of: an amatoxin, α-amanitin, β-amanitin, γ-amanitin, ε-amanitin, amanin, amaninamide, amanullin, amanullinic acid and any functional fragments, derivatives or analogs thereof; or (d) the cytotoxic agent is a DNA-damaging agent selected from the group consisting of: an antitubulin agent, a DNA crosslinking agent, a DNA alkylating agent and a mitotic disrupting agent.

Embodiment 11: A chimeric antigen receptor (CAR) comprising the antibody or antigen binding fragment thereof of any one of embodiments 1 to 5; a spacer domain; a transmembrane domain, and one or more intracellular signaling domains.

Embodiment 12: The CAR of embodiment 11, wherein the spacer domain comprises a hinge domain or fragment thereof selected from the group consisting of: a CD4 hinge, a CD8β hinge, a CD8α hinge, a CD28 hinge, a CD134 hinge, a CD137 hinge, a CD152 hinge, a CD278 hinge, an IgG1 hinge, an IgG2 hinge, an IgG3 hinge, and an IgG4 hinge.

Embodiment 13: The CAR of embodiment 11 or embodiment 12, wherein the spacer domain comprises an amino acid sequence set forth in any one of SEQ ID NOs: 145, 146, 147, 148, 149, and 150 or an amino acid sequence at least 95% identical thereto.

Embodiment 14: The CAR of any one of embodiments 11 to 13, wherein the transmembrane domain is isolated or derived from a polypeptide selected from the group consisting of an alpha, beta, gamma, or delta chain of the T-cell receptor, CD3δ, CD3ε, CD3γ, CD3ζ, CD4, CD5, CD8α, CD9, CD16, CD22, CD27,CD28, CD33, CD37, CD45, CD64, CD80, CD86, CD134, CD137, CD152, CD154, CD278, amnionless (AMN), and programmed cell death 1 (PDCD1).

Embodiment 15: The CAR of any one of embodiments 11 to 14, wherein the transmembrane domain comprises an amino acid sequence set forth in any one of SEQ ID NOS: 151, 152, 153, 154, 155, 156, and 157 or an amino acid sequence at least 95% identical thereto.

Embodiment 16: The CAR of any one of embodiments 11 to 15, wherein the one or more intracellular signaling domains comprises a primary signaling domain isolated or derived from a polypeptide selected from the group consisting of FcRγ, FcRβ, CD3γ, CD3δ, CD3ε, CD3ζ, CD22, CD79a, CD79b, and CD66d.

Embodiment 17: The CAR of any one of embodiments 11 to 16, wherein the one or more intracellular signaling domains comprises a primary signaling domain isolated from CD3ζ.

Embodiment 18: The CAR of embodiment 17, wherein the primary signaling domain comprises an amino acid sequence set forth in SEQ ID NO: 158 or an amino acid sequence at least 95% identical thereto.

Embodiment 19: The CAR of any one of embodiments 11 to 18, wherein the one or more intracellular signaling domains comprises a costimulatory signaling domain isolated or derived from a polypeptide selected from the group consisting of TLR1, TLR2, TLR3, TLR4, TLR5, TLR6, TLR7, TLR8, TLR9, TLR10, CARD11, CD2, CD7, CD27, CD28, CD30, CD40, ICAM, CD83, CD94, CD134 (OX40), CD137 (4-1BB), CD278 (ICOS), DAP10, LAT, SLP76, TRAT1, TNFR2, TNFRS14, TNFRS18, TNFRS25, and ZAP70.

Embodiment 20: The CAR of any one of embodiments 11 to 19, wherein the one or more intracellular signaling domains comprises a costimulatory signaling domain comprising an amino acid sequence set forth in any one of SEQ ID NOs: 159, 160, 161, 162, 163, and 164 or an amino acid sequence at least 95% identical thereto.

Embodiment 21: A CAR comprising an antibody or antigen binding fragment thereof comprises the amino acid sequence set forth in any one of SEQ ID NOs: 39, 59, 70, 90, 101, or 117; a spacer domain comprising the amino acid sequence set forth in any one of SEQ ID NOs: 145, 146, and 148 or an amino acid sequence at least 95% identical thereto; a transmembrane domain comprising the amino acid sequence set forth in SEQ ID NOs: 151 or 153; one or more intracellular signaling domains comprising a costimulatory signaling domain comprising an amino acid sequence set forth in any one of SEQ ID NOs: 159, 160, and 162 or an amino acid sequence at least 95% identical thereto and further comprising a primary signaling domain comprising an amino acid sequence set forth in SEQ ID NO: 158 or an amino acid sequence at least 95% identical thereto.

Embodiment 22: A CAR comprising the amino acid sequence set forth in any one of SEQ ID NOs: 165-860.

Embodiment 23: A CAR comprising the amino acid sequence set forth in any one of SEQ ID NOs: 261, 262, 263, 264, 265, 266, 267, 268, 269, 270, 271, 272, 273, 274, 275, 276, 277, 278, 279, 280, 281, 282, and 283.

Embodiment 24: A CAR comprising the amino acid sequence set forth in any one of SEQ ID NOs: 357, 358, 359, 360, 361, 362,363, 364, 365, 366, 367, 368, 369, 370 371, 372, 373, 374, 375, 376, 377, 378, 379, and 380.

Embodiment 25: A CAR comprising the amino acid sequence set forth in any one of SEQ ID NOs: 429, 430, 431, 432, 433, 434, 435, 436, 437, 438, 439, 440, 441, 442, 443, 444, 445, 446, 447, 448, 449, 450, 451, and 452.

Embodiment 26: A CAR comprising the amino acid sequence set forth in any one of SEQ ID NOs: 525, 526, 527, 528, 529, 530, 531, 532, 533, 534, 535, 536, 537, 538, 539, 540, 541, 542, 543, 544, 545, 546, 547, and 548.

Embodiment 27: A CAR comprising the amino acid sequence set forth in any one of SEQ ID NOs: 597, 598, 599, 600, 601, 602, 603, 604, 605, 606, 607, 608, 609, 610, 611, 612, 613, 614, 615, 616, 617, 618, 619, and 620.

Embodiment 28: A CAR comprising the amino acid sequence set forth in any one of SEQ ID NOs: 693, 694, 695, 696, 697, 698, 699, 700, 701, 702, 703, 704, 705, 706, 707, 708, 709, 710, 711, 712, 713, 714, 715, and 716.

Embodiment 29: The CAR of any one of embodiments 11 to 28, further comprising a signal peptide.

Embodiment 30: The CAR of embodiment 29, wherein the signal peptide comprises an amino acid sequence set forth in any one of SEQ ID NOs: 861, 862, 863, 864, 865, 866, 867, 868, 869, 870, 871, 872, and 873.

Embodiment 31: A polynucleotide encoding a CAR, comprising a polynucleotide sequence set forth in any one of SEQ ID NOs: 905-924.

Embodiment 32: A polynucleotide encoding a signal peptide and a CAR comprising a polynucleotide sequence set forth in any one of SEQ ID NOs: 925-944.

Embodiment 33: A polynucleotide encoding the antibody or antigen binding fragment thereof of any one of embodiments 1 to 5, the bispecific antibody of embodiment 6 or embodiment 7, the antibody conjugate of any one of embodiments 8 to 10, or the CAR of any one of embodiments 11 to 30.

Embodiment 34: A polynucleotide encoding or comprising a promoter operably linked to a polynucleotide of any one of embodiments 31 to 33.

Embodiment 35: The polynucleotide of embodiment 34, wherein the promoter comprises the polynucleotide sequence set forth in any one of SEQ ID NOs: 980, 981, 982, 983, 984, and 985.

Embodiment 36: The polynucleotide of embodiment 34 or embodiment 35, further comprising a post-transcriptional response element.

Embodiment 37: The polynucleotide of embodiment 36, wherein the post-transcriptional response element comprises the polynucleotide sequence set forth in any one of SEQ ID NOs: 945, 946, and 947.

Embodiment 38: A DNA comprising the polynucleotide sequence of any one of embodiments 31 to 37.

Embodiment 39: An RNA encoded by the polynucleotide sequence of any one of embodiments 31 to 37.

Embodiment 40: A vector comprising the polynucleotide of any one of embodiments 31 to 39.

Embodiment 41: A vector encoding or comprising a promoter comprising a sequence set forth in SEQ ID NO: 950 operably linked to a polynucleotide encoding a signal peptide and a chimeric antigen receptor comprising an anti-BCMA antibody or antigen binding fragment thereof comprising an amino acid set forth in any one of SEQ ID NOs: 11-144, and optionally comprising a polynucleotide comprising a posttranscriptional regulatory element set forth in any one of SEQ ID NOs: 945-947.

Embodiment 42: A vector encoding or comprising a promoter comprising a sequence set forth in SEQ ID NO: 950 operably linked to a polynucleotide encoding a signal peptide and a chimeric antigen receptor comprising an anti-BCMA antibody or antigen binding fragment thereof comprising an amino acid set forth in any one of SEQ ID NOs: 20, 30, 39, 50, 59, 70, 80, 90, 100, 101, 105, 109, 113, 117, 121, 125, 129, 133, 137, and 141, and optionally comprising a polynucleotide comprising a posttranscriptional regulatory element set forth in any one of SEQ ID NOs: 945-947.

Embodiment 43: A vector encoding or comprising a promoter comprising a sequence set forth in SEQ ID NO: 950 operably linked to a polynucleotide encoding a signal peptide and a chimeric antigen receptor comprising an amino acid set forth in any one of SEQ ID NOs: 165-860, and optionally comprising a polynucleotide comprising a posttranscriptional regulatory element set forth in any one of SEQ ID NOs: 945-947.

Embodiment 44: A vector encoding or comprising a promoter comprising a sequence set forth in SEQ ID NO: 950 operably linked to a polynucleotide encoding a signal peptide and a chimeric antigen receptor comprising an amino acid set forth in any one of SEQ ID NOs: 189, 237, 261, 333, 357, 429, 477, 525, 573, 597, 621, 645, 669, 693, 717, 741, 765, 789, 813, and 837, and optionally comprising a polynucleotide comprising a posttranscriptional regulatory element set forth in any one of SEQ ID NOs: 945-947.

Embodiment 45: A vector encoding or comprising a promoter comprising a sequence set forth in SEQ ID NO: 950 operably linked to a polynucleotide comprising a polynucleotide sequence set forth in SEQ ID NO: 904 and a polynucleotide sequence set forth in any one of SEQ ID NOs: 905-924, and optionally comprising a polynucleotide comprising a posttranscriptional regulatory element set forth in any one of SEQ ID NOs: 945-947.

Embodiment 46: A vector encoding or comprising a promoter comprising a sequence set forth in SEQ ID NO: 950 operably linked to a polynucleotide comprising a polynucleotide sequence set forth in any one of SEQ ID NOs: 925-944, and optionally comprising a polynucleotide comprising a posttranscriptional regulatory element set forth in any one of SEQ ID NOs: 945-947.

Embodiment 47: A vector encoding or comprising a promoter comprising a sequence set forth in SEQ ID NO: 949 operably linked to a polynucleotide encoding a signal peptide and a chimeric antigen receptor comprising an anti-BCMA antibody or antigen binding fragment thereof comprising an amino acid set forth in any one of SEQ ID NOs: 11-144, and optionally comprising a polynucleotide comprising a posttranscriptional regulatory element set forth in any one of SEQ ID NOs: 945-947.

Embodiment 48: A vector encoding or comprising a promoter comprising a sequence set forth in SEQ ID NO: 949 operably linked to a polynucleotide encoding a signal peptide and a chimeric antigen receptor comprising an anti-BCMA antibody or antigen binding fragment thereof comprising an amino acid set forth in any one of SEQ ID NOs: 20, 30, 39, 50, 59, 70, 80, 90, 100, 101, 105, 109, 113, 117, 121, 125, 129, 133, 137, and 141, and optionally comprising a polynucleotide comprising a posttranscriptional regulatory element set forth in any one of SEQ ID NOs: 945-947.

Embodiment 49: A vector encoding or comprising a promoter comprising a sequence set forth in SEQ ID NO: 949 operably linked to a polynucleotide encoding a signal peptide and a chimeric antigen receptor comprising an amino acid set forth in any one of SEQ ID NOs: 165-860, and optionally comprising a polynucleotide comprising a posttranscriptional regulatory element set forth in any one of SEQ ID NOs: 945-947.

Embodiment 50: A vector encoding or comprising a promoter comprising a sequence set forth in SEQ ID NO: 949 operably linked to a polynucleotide encoding a signal peptide and a chimeric antigen receptor comprising an amino acid set forth in any one of SEQ ID NOs: 189, 237, 261, 333, 357, 429, 477, 525, 573, 597, 621, 645, 669, 693, 717, 741, 765, 789, 813, and 837, and optionally comprising a polynucleotide comprising a posttranscriptional regulatory element set forth in any one of SEQ ID NOs: 945-947.

Embodiment 51: A vector encoding or comprising a promoter comprising a sequence set forth in SEQ ID NO: 949 operably linked to a polynucleotide comprising a polynucleotide sequence set forth in SEQ ID NO: 904 and a polynucleotide sequence set forth in any one of SEQ ID NOs: 905-924, and optionally comprising a polynucleotide comprising a posttranscriptional regulatory element set forth in any one of SEQ ID NOs: 945-947.

Embodiment 52: A vector encoding or comprising a promoter comprising a sequence set forth in SEQ ID NO: 949 operably linked to a polynucleotide comprising a polynucleotide sequence set forth in any one of SEQ ID NOs: 925-944, and optionally comprising a polynucleotide comprising a posttranscriptional regulatory element set forth in any one of SEQ ID NOs: 945-947.

Embodiment 53: The vector of embodiment any one of embodiments 40 to 52, wherein the vector is an expression vector.

Embodiment 54: The vector of embodiment any one of embodiments 40 to 52, wherein the vector is a transfer plasmid or viral vector.

Embodiment 55: The vector of embodiment any one of embodiments 40 to 52, wherein the vector is a plasmid.

Embodiment 56: The vector of embodiment any one of embodiments 40 to 54, wherein the vector is a viral vector selected from the group consisting of an adenoviral (Ad) vector, an adeno-associated virus (AAV) vector, a herpes simplex virus (HSV) vector, a parvovirus vector, a rhabdovirus vector, a vesiculovirus vector, a paramyxovirus vector, a morbillovirus vector, a henipavirus vector, an alphavirus vector, a flavivirus vector, a retroviral vector, and a lentiviral vector (LVV).

Embodiment 57: The vector of embodiment 56, wherein the lentiviral vector is engineered or derived from the genome of a lentivirus selected from the group consisting of: HIV (HIV type 1 or HIV type 2); visna-maedi virus (VMV); caprine arthritis-encephalitis virus (CAEV); equine infectious anemia virus (EIAV); feline immunodeficiency virus (FIV); bovine immune deficiency virus (BIV); and simian immunodeficiency virus (SIV).

Embodiment 58: A lentiviral vector comprising: a 5' long terminal repeat (LTR) comprising R and U5 regions; a Psi (Ψ) packaging signal; a cPPT/FLAP; an export element; a polynucleotide encoding or comprising a promoter operably linked to a polynucleotide sequence set forth in SEQ ID NO: 904 and a polynucleotide sequence set forth in any one of SEQ ID NOS: 905-924; optionally a WPRE; a 3' LTR comprising U3 and R regions; a polyadenylation signal, and a poly(A) tail.

Embodiment 59: A lentiviral vector comprising: a 5' long terminal repeat (LTR) comprising R and U5 regions; a Psi (Ψ) packaging signal; a cPPT/FLAP; an export element; a polynucleotide encoding or comprising a promoter operably linked to a polynucleotide sequence set forth in any one of SEQ ID NOs: 925-944; optionally a WPRE; a 3' LTR comprising U3 and R regions; a polyadenylation signal, and a poly(A) tail.

Embodiment 60: An RNA comprising: a 5' long terminal repeat (LTR) comprising R and U5 regions; a Psi (Ψ) packaging signal; a cPPT/FLAP; an export element; a polynucleotide encoding a promoter operably linked to a polynucleotide sequence set forth in SEQ ID NO: 904 and a polynucleotide sequence set forth in any one of SEQ ID NOs: 905-924; optionally a WPRE; a 3' LTR comprising U3 and R regions; a polyadenylation signal, and optionally a poly(A) tail.

Embodiment 61: An RNA comprising: a 5' long terminal repeat (LTR) comprising R and U5 regions; a Psi (Ψ) packaging signal; a cPPT/FLAP; an export element; a polynucleotide encoding a promoter operably linked to a polynucleotide sequence set forth in any one of SEQ ID NOs: 925-944; optionally a WPRE; a 3' LTR comprising U3 and R regions; a polyadenylation signal, and optionally a poly (A) tail.

Embodiment 62: The lentiviral vector of embodiments 58 or 59, wherein the vector encodes a promoter sequence set forth in SEQ ID NO: 949 or 950.

Embodiment 63: The RNA of embodiments 60 or 61, wherein the RNA encodes a promoter sequence set forth in SEQ ID NO: 949 or 950.

Embodiment 64: A recombinant lentivirus comprising one or more copies of the lentiviral vector of any one of embodiments 58-60 or the RNA of any one of embodiments 61-63.

Embodiment 65: A composition comprising the antibody or antigen binding fragment thereof of any one of embodiments 1 to 5, the bispecific antibody of embodiment 6 or embodiment 7, the antibody conjugate of any one of embodiments 8 to 10, the CAR of any one of embodiments 11 to 30, the polynucleotide of any one of embodiments 31 to 39, the vector of any one of embodiments 40 to 60, the RNA of any one of embodiments 61-63, or the recombinant lentivirus of embodiment 64.

All publications, patent applications, and issued patents cited in this specification are herein incorporated by reference as if each individual publication, patent application, or issued patent were specifically and individually indicated to be incorporated by reference.

Although the foregoing embodiments have been described in some detail by way of illustration and example for purposes of clarity of understanding, it will be readily apparent to one of ordinary skill in the art in light of the teachings contemplated herein that certain changes and modifications may be made thereto without departing from the spirit or scope of the appended claims. The following examples are provided by way of illustration only and not by way of limitation. Those of skill in the art will readily recognize a variety of noncritical parameters that could be changed or modified to yield essentially similar results.

K. EXAMPLES

Example 1

Recombinant Lentivirus Delivers Functional Anti-BCMA Cars to T Cells

Recombinant T cell specific lentiviral particles with a viral envelope expressing a mutated viral envelope glycoprotein (fusogen) and a non-viral membrane bound tropism molecule and harboring a lentiviral vector encoding an anti-BCMA CAR were generated. FIG. 1.

HEK293T cells were transfected with plasmids encoding a non-viral membrane bound tropism molecule comprising an anti-CD3 scFv fused to a CD8α hinge and transmembrane domain; a mutant VSIV-G fusogen comprising K47Q and R354A amino acid substitutions; lentiviral GAG/POL; lentiviral REV; and a transfer plasmid encoding a lentiviral vector comprising an MNDU3 promoter operably linked to a polynucleotide encoding a CD8α signal peptide and an anti-BCMA CAR and a WPRE element operably linked to the 3' end of the polynucleotide encoding the anti-BCMA CAR.

Table 10 lists the recombinant lentivirus (LV) reference number and the corresponding SEQ ID NOs of the amino acid sequences of the anti-BCMA CARs and their CARchitectures.

TABLE 10

| LV Ref. | SEQ ID NO. | anti-BCMA binding domain | Hinge | TM | Costim | Primary |
|---|---|---|---|---|---|---|
| LV 1 | 189 | scFv | CD8α | CD8α | CD137 | CD3ζ |
| LV 2 | 237 | scFv | CD8α | CD8α | CD137 | CD3ζ |
| LV 3 | 261 | scFv | CD8α | CD8α | CD137 | CD3ζ |
| LV 4 | 333 | scFv | CD8α | CD8α | CD137 | CD3ζ |
| LV 5 | 357 | scFv | CD8α | CD8α | CD137 | CD3ζ |
| LV 6 | 429 | scFv | CD8α | CD8α | CD137 | CD3ζ |
| LV 7 | 477 | scFv | CD8α | CD8α | CD137 | CD3ζ |
| LV 8 | 525 | scFv | CD8α | CD8α | CD137 | CD3ζ |
| LV 9 | 597 | VHH | CD8α | CD8α | CD137 | CD3ζ |
| LV 10 | 621 | VHH | CD8α | CD8α | CD137 | CD3ζ |
| LV 11 | 645 | VHH | CD8α | CD8α | CD137 | CD3ζ |
| LV 12 | 669 | VHH | CD8α | CD8α | CD137 | CD3ζ |
| LV 13 | 693 | VHH | CD8α | CD8α | CD137 | CD3ζ |
| LV 14 | 717 | VHH | CD8α | CD8α | CD137 | CD3ζ |
| LV 15 | 741 | VHH | CD8α | CD8α | CD137 | CD3ζ |
| LV 16 | 789 | VHH | CD8α | CD8α | CD137 | CD3ζ |
| LV 17 | 813 | VHH | CD8α | CD8α | CD137 | CD3ζ |
| LV 18 | 837 | VHH | CD8α | CD8α | CD137 | CD3ζ |
| LV 19 | NA | scFv | CD8α | CD8α | CD137 | CD3ζ |

Figure 2A:
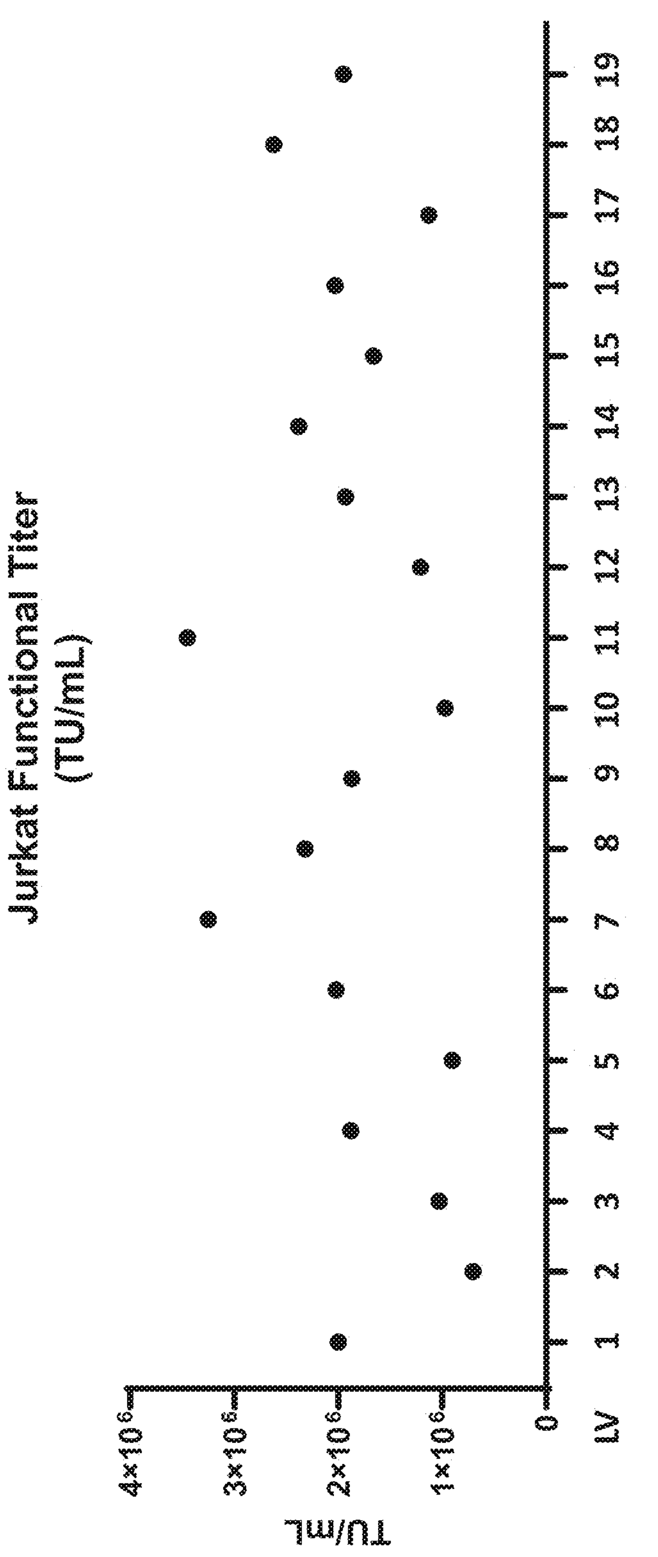
FIG. 2A shows Jurkat cell titer of recombinant lentiviruses comprising a viral envelope expressing a mutated vesicular stomatitis Indiana virus envelope glycoprotein G (VSIV-G) and a non-viral membrane-bound tropism polypeptide that binds CD3 and a lentiviral vector encoding an MNDU3 promoter operably linked to a polynucleotide encoding a CD8a signal peptide and an anti-BCMA CAR and a WPRE operably linked to the 3' prime end of the polynucleotide encoding the anti-BCMA CAR (18 anti-BCMA CARs were evaluated).

Jurkat Functional Titer $1\times10^5$ Jurkat cells were plated in each well of a 96-well plate. Cells were transduced with recombinant lentiviruses LV 1 to LV 18 that harbor novel anti-BCMA CARs and LV 19, which harbors a control anti-BCMA CAR obtained from the literature. Seven days post-transduction, Jurkat cells were harvested and stained with a recombinant, phycoerythrin (PE) labeled, BCMA extracellular domain-FC fusion protein (BCMA-PE) and analyzed by flow cytometry. Functional titer, expressed as the number of transducing units (TU) per mL, was determined by measuring the number of transduced Jurkat cells. FIG. 2A.

Figure 2B:
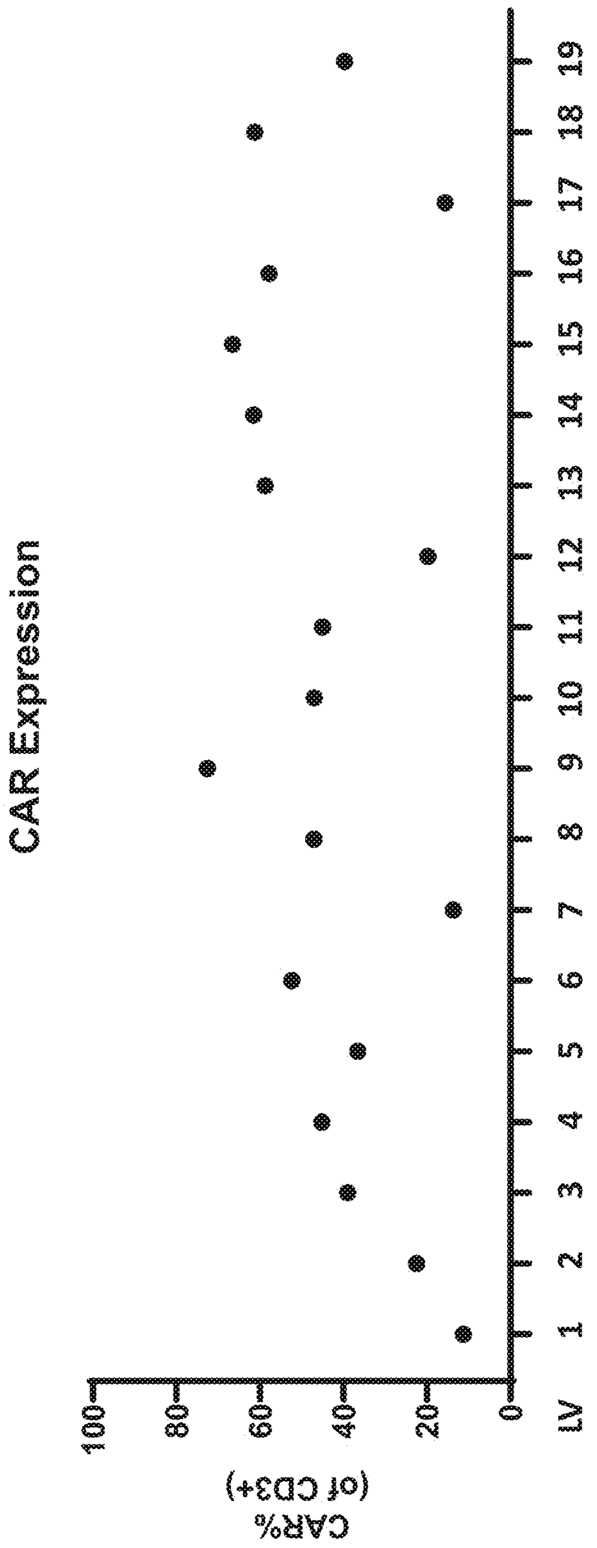
FIG. 2B shows anti-BCMA CAR expression on PBMCs transduced with recombinant lentiviral particles comprising a viral envelope expressing a mutated VSIV-G and a non-viral membrane-bound tropism polypeptide that binds CD3 and a lentiviral vector encoding an MNDU3 promoter operably linked to a polynucleotide encoding a CD8a signal peptide and an anti-BCMA CAR and a WPRE operably linked to the 3' prime end of the polynucleotide encoding the anti-BCMA CAR (18 anti-BCMA CARs were evaluated).
Figure 2C:
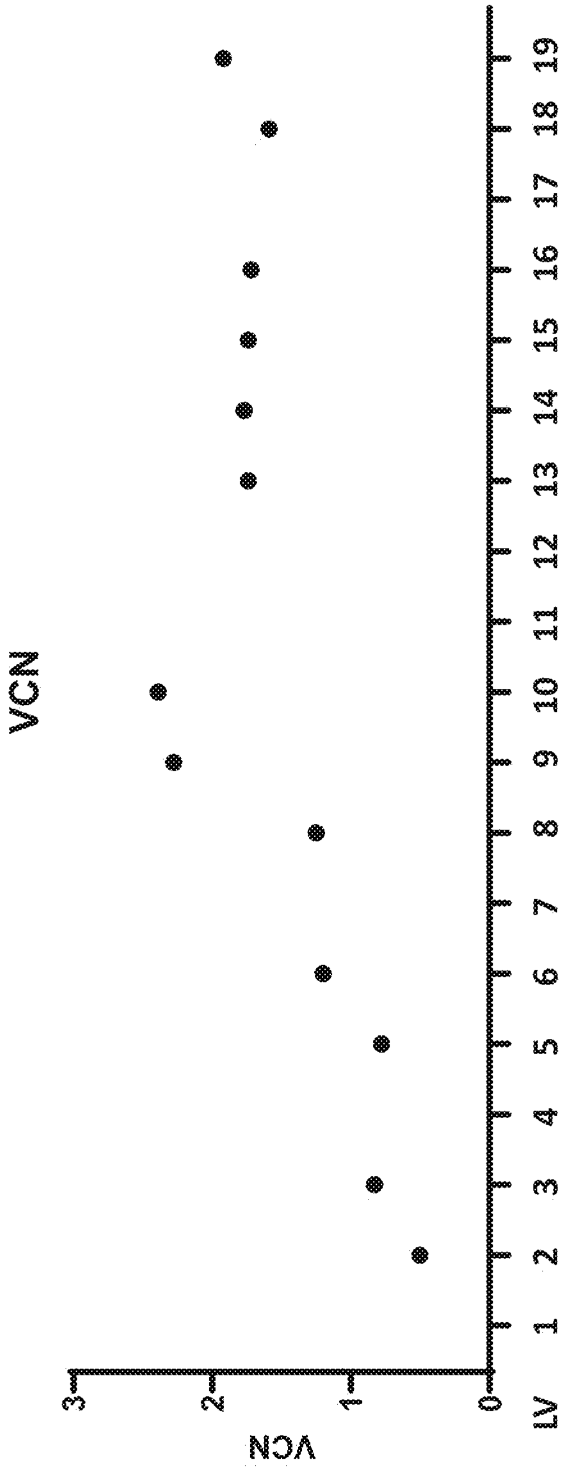
FIG. 2C shows the vector copy number (VCN) in PBMCs transduced with recombinant lentiviral particles comprising a viral envelope expressing a mutated VSIV-G and a non-viral membrane-bound tropism polypeptide that binds CD3 and a lentiviral vector encoding an MNDU3 promoter operably linked to a polynucleotide encoding a CD8a signal peptide and an anti-BCMA CAR and a WPRE operably linked to the 3' prime end of the polynucleotide encoding the anti-BCMA CAR (18 anti-BCMA CARs were evaluated).

Anti-BCMA CAR Expression $5\times10^5$ human PBMCs were plated in each well of a 24-well plate. Cells were transduced with recombinant lentiviruses LV 1 to LV 19 at a MOI 2 based on the Jurkat functional titer, or a 0.5 mL volumetric transduction if MOI 2 was not achievable. Seven days post-transduction, PBMCs were harvested and stained with BCMA-PE and analyzed by flow cytometry to assess the percentage of anti-BCMA CAR expressing cells. FIG. 2B.

Figure 2D:
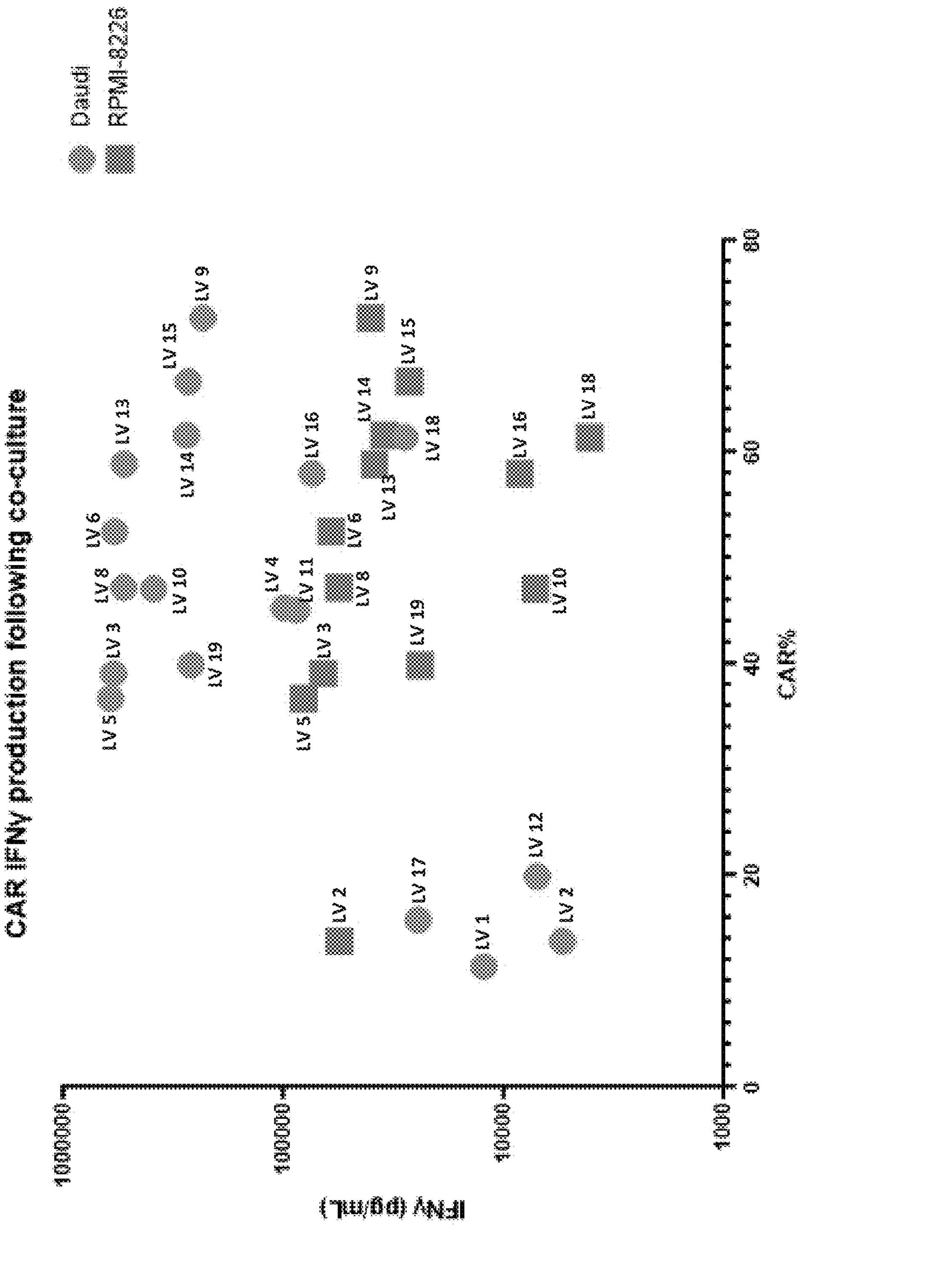
FIG. 2D shows the anti-BCMA CAR activity measured as the amount of IFNy produced in a co-culture assay. PBMCs transduced with recombinant lentiviral particles comprising a viral envelope expressing a mutated VSIV-G and a non-viral membrane-bound tropism polypeptide that binds CD3 and a lentiviral vector encoding an MNDU3 promoter operably linked to a polynucleotide encoding a CD8α signal peptide and an anti-BCMA CAR and a WPRE operably linked to the 3' prime end of the polynucleotide encoding the anti-BCMA CAR (18 anti-BCMA CARs were evaluated) were co-cultured with Daudi cells (low BCMA expression) or RPMI-8226 cells (high BCMA expression) for 24 hours. After 24 hours, IFNγ levels in co-culture supernatant were measured and plotted as a function of % anti-BCMA CAR positive cells in the co-culture.

Anti-BCMA CAR Activity $5\times10^4$ PBMCs transduced with recombinant lentiviruses LV 1 to LV 19 were co-cultured with $5\times10^4$ high BCMA-expressing tumor cells (RPMI-8226) or $5\times10^4$ low BCMA-expressing tumor cells (Daudi) for 24 hours. Anti-BCMA CAR activity was assessed by harvesting co-culture supernatants and measuring IFNγ levels using a Meso Scale Discovery (MSD®) assay. The percentage of anti-BCMA CAR positive cells was plotted against IFNγ levels produced in co-culture. FIG. 2D.

SUMMARY

These data indicate that the recombinant T cell specific lentiviral particles harboring anti-BCMA CARs (LV 1 to LV 18) are able to transduce CD3 expressing cells, that anti-BCMA CARs are expressed on PBMCs transduced with LV 1 to LV 18 and that the transduced PBMCs express anti-BCMA CARs that recognize high or low BCMA-expressing cells and produce IFNγ in response to binding antigen.

Example 2

Lentiviral Vector Architecture and Anti-BCMA Car Expression and Function

Recombinant T cell specific lentiviral particles with a viral envelope expressing a mutated viral envelope glycoprotein (fusogen) and a non-viral membrane bound tropism molecule and harboring a lentiviral vector encoding various promoters, anti-BCMA CARs, and either no posttranscriptional response element (PRE) or a wild-type WPRE, or a mutated WPRE.

HEK293T cells were transfected with plasmids encoding a non-viral membrane bound tropism molecule comprising an anti-CD3 scFv fused to a CD8α hinge and transmembrane domain; a mutant VSIV-G fusogen comprising K47Q and R354A amino acid substitutions; lentiviral GAG/POL; lentiviral REV; and a transfer plasmid encoding a lentiviral vector comprising either an MNDU3 promoter (SEQ ID NO: 950), an SFFV promoter (SEQ ID NO: 952), or an EF1α promoter (SEQ ID NO: 949) operably linked to a polynucleotide encoding a CD8α signal peptide and an anti-BCMA CAR and either no posttranscriptional response element or a wild-type WPRE (SEQ ID NO: 945) or a mutated WPRE (SEQ ID NO: 946) operably linked to the 3' end of the polynucleotide encoding the anti-BCMA CAR.

Table 11 lists the recombinant lentivirus reference number and the corresponding SEQ ID NOs of the amino acid sequences of the anti-BCMA CARs and the different lentiviral vector architectures.

TABLE 11

| Ref. | SEQ ID NO. | Promoter | WPRE |
|---|---|---|---|
| LV 3.1 | 261 | MNDU3 | wild-type |
| LV 3.2 | 261 | MNDU3 | no PRE |
| LV 3.3 | 261 | MNDU3 | mutant WPRE |
| LV 3.4 | 261 | SFFV | wild-type |
| LV 3.5 | 261 | SFFV | no PRE |
| LV 3.6 | 261 | SFFV | mutant WPRE |
| LV 3.7 | 261 | EF1α | wild-type |
| LV 3.8 | 261 | EF1α | no PRE |
| LV 3.9 | 261 | EF1α | mutant WPRE |
| LV 5.1 | 357 | MNDU3 | wild-type |
| LV 5.2 | 357 | MNDU3 | no PRE |

TABLE 11-continued

| Ref. | SEQ ID NO. | Promoter | WPRE |
|---|---|---|---|
| LV 5.3 | 357 | MNDU3 | mutant WPRE |
| LV 5.4 | 357 | SFFV | wild-type |
| LV 5.5 | 357 | SFFV | no PRE |
| LV 5.6 | 357 | SFFV | mutant WPRE |
| LV 5.7 | 357 | EF1α | wild-type |
| LV 5.8 | 357 | EF1α | no PRE |
| LV 5.9 | 357 | EF1α | mutant WPRE |
| LV 6.1 | 429 | MNDU3 | wild-type |
| LV 6.2 | 429 | MNDU3 | no PRE |
| LV 6.3 | 429 | MNDU3 | mutant WPRE |
| LV 6.4 | 429 | SFFV | wild-type |
| LV 6.5 | 429 | SFFV | no PRE |
| LV 6.6 | 429 | SFFV | mutant WPRE |
| LV 6.7 | 429 | EF1α | wild-type |
| LV 6.8 | 429 | EF1α | no PRE |
| LV 6.9 | 429 | EF1α | mutant WPRE |
| LV 8.1 | 525 | MNDU3 | wild-type |
| LV 8.2 | 525 | MNDU3 | no PRE |
| LV 8.3 | 525 | MNDU3 | mutant WPRE |
| LV 8.4 | 525 | SFFV | wild-type |
| LV 8.5 | 525 | SFFV | no PRE |
| LV 8.6 | 525 | SFFV | mutant WPRE |
| LV 8.7 | 525 | EF1α | wild-type |
| LV 8.8 | 525 | EF1α | no PRE |
| LV 8.9 | 525 | EF1α | mutant WPRE |
| LV 9.1 | 597 | MNDU3 | wild-type |
| LV 9.2 | 597 | MNDU3 | no PRE |
| LV 9.3 | 597 | MNDU3 | mutant WPRE |
| LV 9.4 | 597 | SFFV | wild-type |
| LV 9.5 | 597 | SFFV | no PRE |
| LV 9.6 | 597 | SFFV | mutant WPRE |
| LV 9.7 | 597 | EF1α | wild-type |
| LV 9.8 | 597 | EF1α | no PRE |
| LV 9.9 | 597 | EF1α | mutant WPRE |
| LV 13.1 | 693 | MNDU3 | wild-type |
| LV 13.2 | 693 | MNDU3 | no PRE |
| LV 13.3 | 693 | MNDU3 | mutant WPRE |
| LV 13.4 | 693 | SFFV | wild-type |
| LV 13.5 | 693 | SFFV | no PRE |
| LV 13.6 | 693 | SFFV | mutant WPRE |
| LV 13.7 | 693 | EF1α | wild-type |
| LV 13.8 | 693 | EF1α | no PRE |
| LV 13.9 | 693 | EF1α | mutant WPRE |
| LV19 | | MNDU3 | no PRE |

Figure 3A:
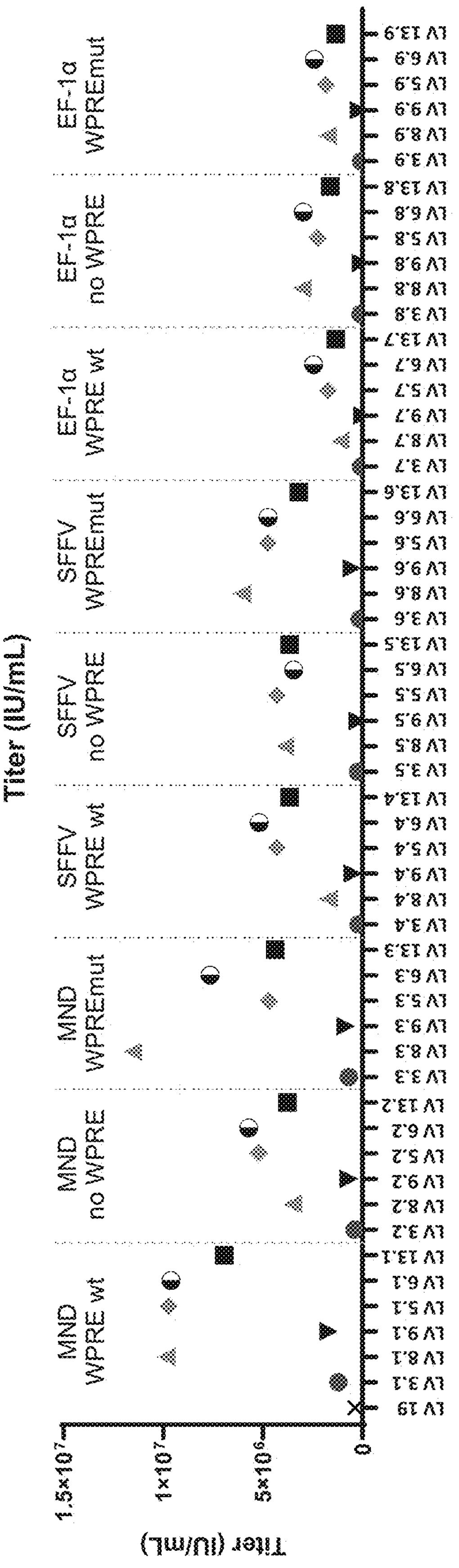
FIG. 3A shows Jurkat cell functional titer of recombinant lentivirus comprising a viral envelope expressing a mutated VSIV-G and a non-viral membrane-bound tropism polypeptide that binds CD3 and a lentiviral vector encoding either an MNDU3 promoter, an SFFV promoter, or an EF1α promoter operably linked to a polynucleotide encoding a CD8α signal peptide and an anti-BCMA CAR (6 anti-BCMA CARs were evaluated) and either no PRE or a wild-type or mutated WPRE operably linked to the 3' prime end of the polynucleotide encoding the anti-BCMA CAR.

Infectious Titer $1\times10^5$ Jurkat cells were plated in each well of a 96-well plate and transduced with the recombinant lentiviruses listed in Table 11 including LV 19, which harbors a lentiviral vector encoding a control anti-BCMA CAR obtained from the literature. Three days post-transduction, the cells were passaged. Seven days post-transduction the cells were harvested. Genomic DNA was isolated and purified from the harvested cells and used in a quantitative PCR (qPCR) assay to determine vector copy number (VCN) and subsequently, IU/mL. FIG. 3A.

All lentiviral vector architectures examined produced infectious titers and were subsequently used to transduce PBMCs.

VCN and Anti-BCMA CAR Expression $5\times10^5$ human PBMCs were plated in each well of a 24-well plate and transduced with volume matched recombinant lentiviruses listed in Table 11.

Figure 3B:
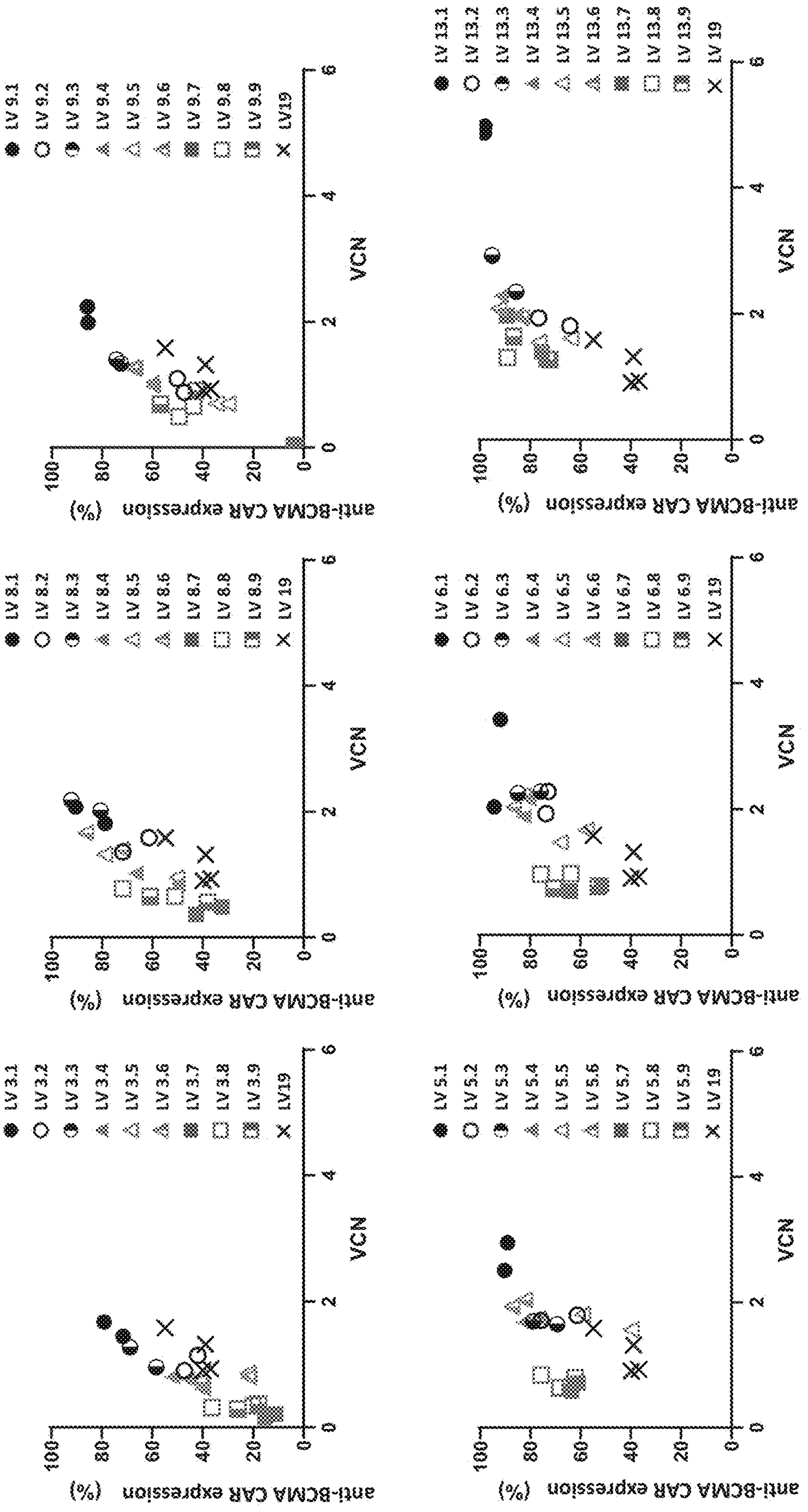
FIG. 3B shows the VCN in transduced PBMCs as a function of the percentage of PBMCs expressing an anti-BCMA CAR. Human PBMCs were transduced with a recombinant lentivirus comprising a viral envelope expressing a mutated VSIV-G and a non-viral membrane-bound tropism polypeptide that binds CD3 and a lentiviral vector encoding either an MNDU3 promoter, an SFFV promoter, or an EF1α promoter operably linked to a polynucleotide encoding a CD8α signal peptide and an anti-BCMA CAR (6 anti-BCMA CARs were evaluated) and either no PRE or a wild-type or mutated WPRE operably linked to the 3' prime end of the polynucleotide encoding the anti-BCMA CAR.

Four days post-transduction, PBMCs were passaged to a 24-well GREX plate. Seven days post-transduction, PBMCs were harvested, one aliquot of cells was stained with BCMA-PE and analyzed by flow cytometry to assess the percentage of anti-BCMA CAR expressing cells and another aliquot was used to isolate and purify genomic DNA for a quantitative PCR (qPCR) assay to determine vector copy number (VCN). FIG. 3B.

These data show that different lentiviral vector architectures tested in combination with different anti-BCMA CARs result in a spectrum of transduction and anti-BCMA CAR expression.

Anti-BCMA CAR Activity $5\times10^5$ human PBMCs were plated in each well of a 24-well plate and transduced with recombinant lentiviruses listed in Table 11 that have the following lentiviral vector architectures: MNDU3 promoter and wild-type WPRE, MNDU3 promoter and a mutated WPRE, SFFV promoter and a mutated WPRE, and EF1α promoter and no WPRE. PBMCs were transduced at an MOI of 1 (based on IU/mL determined in Jurkat cells), except for LV 3.6, LV 3.8, LV 9.8, and LV 13.8, in which volume matched lentivirus was used. Four days post-transduction, PBMCs were passaged to a 24-well GREX plate. Seven days post-transduction, PBMCs were harvested, one aliquot of cells was stained with BCMA-PE and analyzed by flow cytometry to assess the number of anti-BCMA CAR expressing cells and another aliquot was used in co-culture assays to assess anti-BCMA CAR function.

Figure 3C:
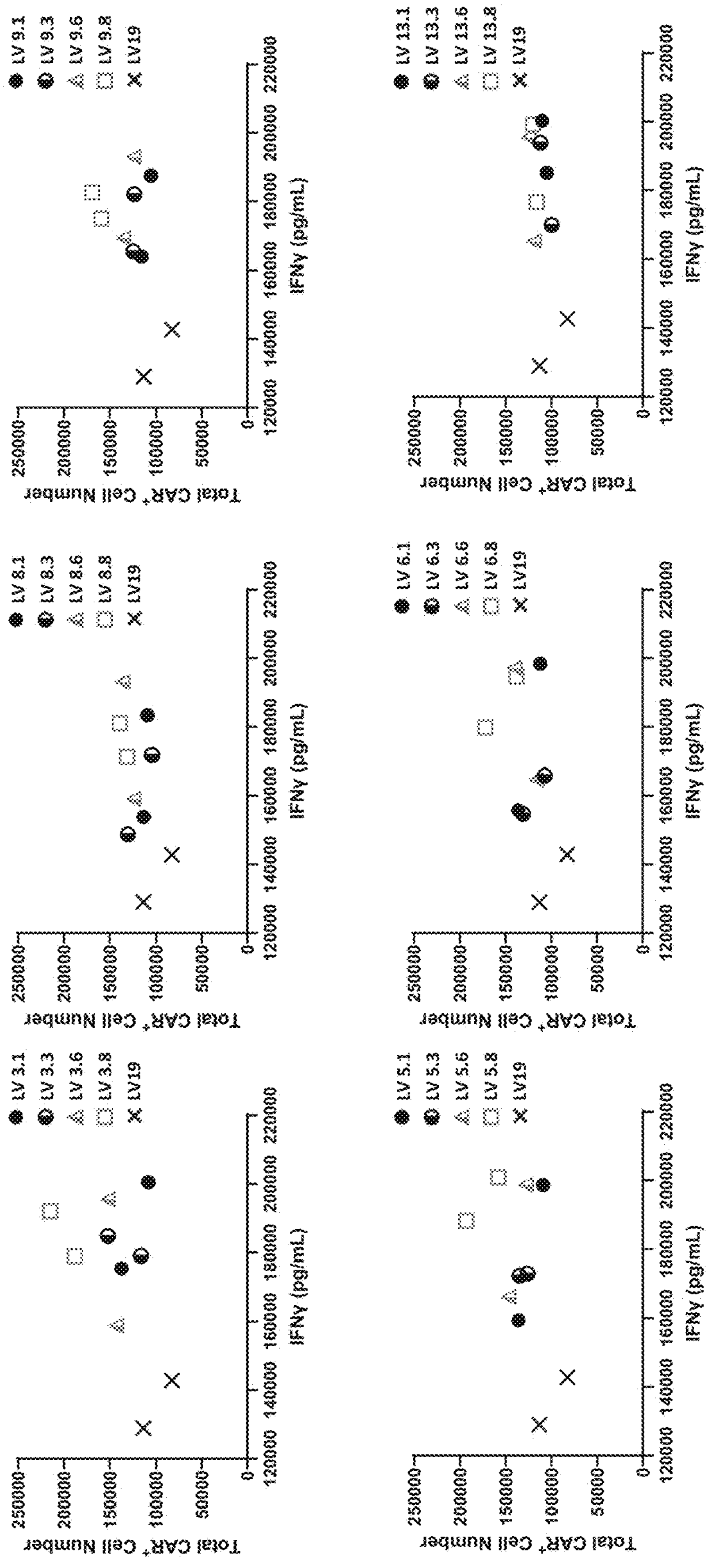
FIG. 3C shows the amount of IFNγ secreted from PBMCs expressing an anti-BCMA CAR co-cultured with RPMI-8226 cells (BCMA expressing cells) for 24 hours as a function of the percentage of CAR-expressing cells in the co-culture.
Figure 3D:
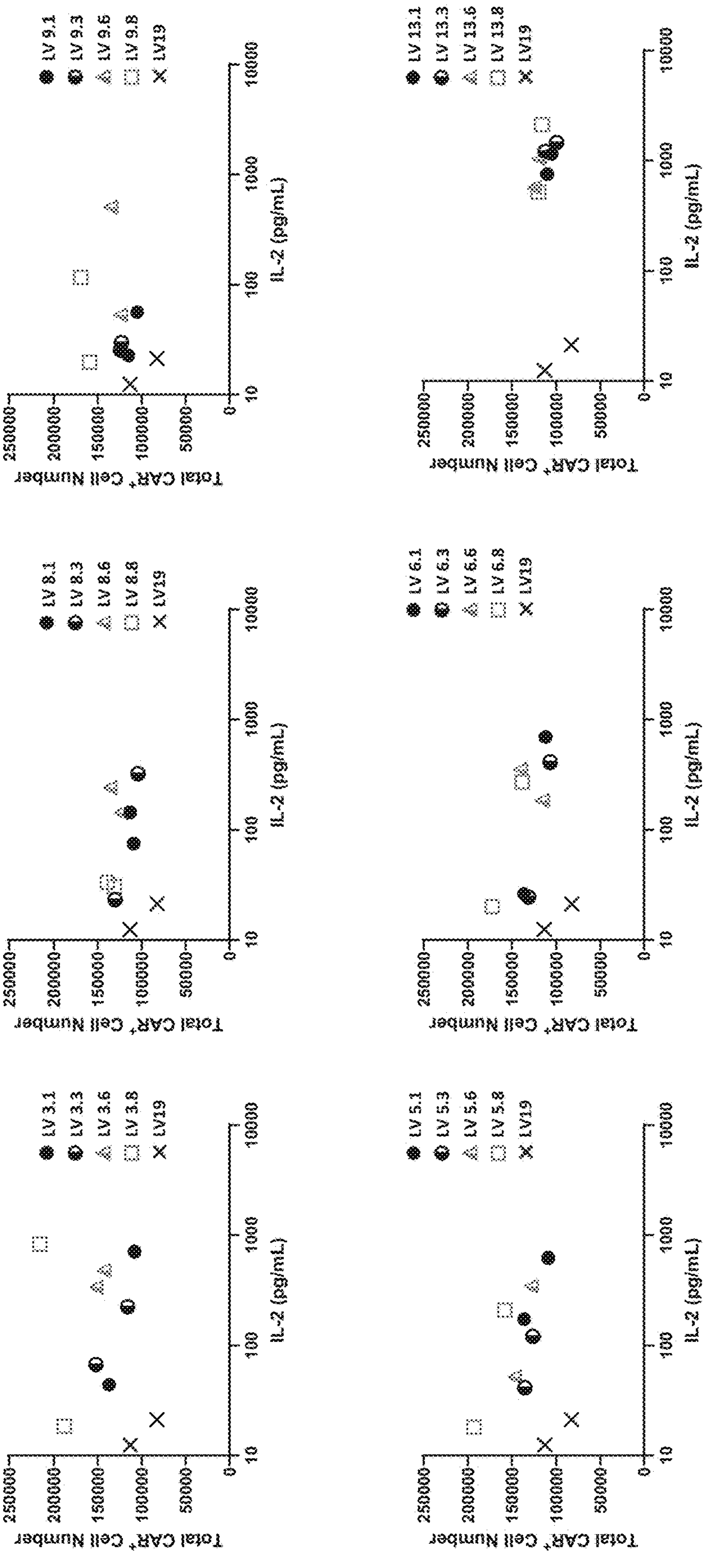
FIG. 3D shows the amount of IL-2 secreted from PBMCs expressing an anti-BCMA CAR co-cultured with RPMI-8226 cells (BCMA expressing cells) for 24 hours as a function of the percentage of CAR-expressing cells in the co-culture.

$5\times10^4$ transduced PBMCs were co-cultured with $5\times10^4$ RPMI-8226 cells for 24 hours. Anti-BCMA CAR activity was assessed by harvesting PBMC/RPMI-8226 cell co-culture supernatants and measuring IFNγ and IL-2 levels using an MSD assay. IFNγ and IL-2 levels produced in co-culture were plotted against the percentage of anti-BCMA CAR positive cells. FIGS. 3C and 3D.

Figure 3E:
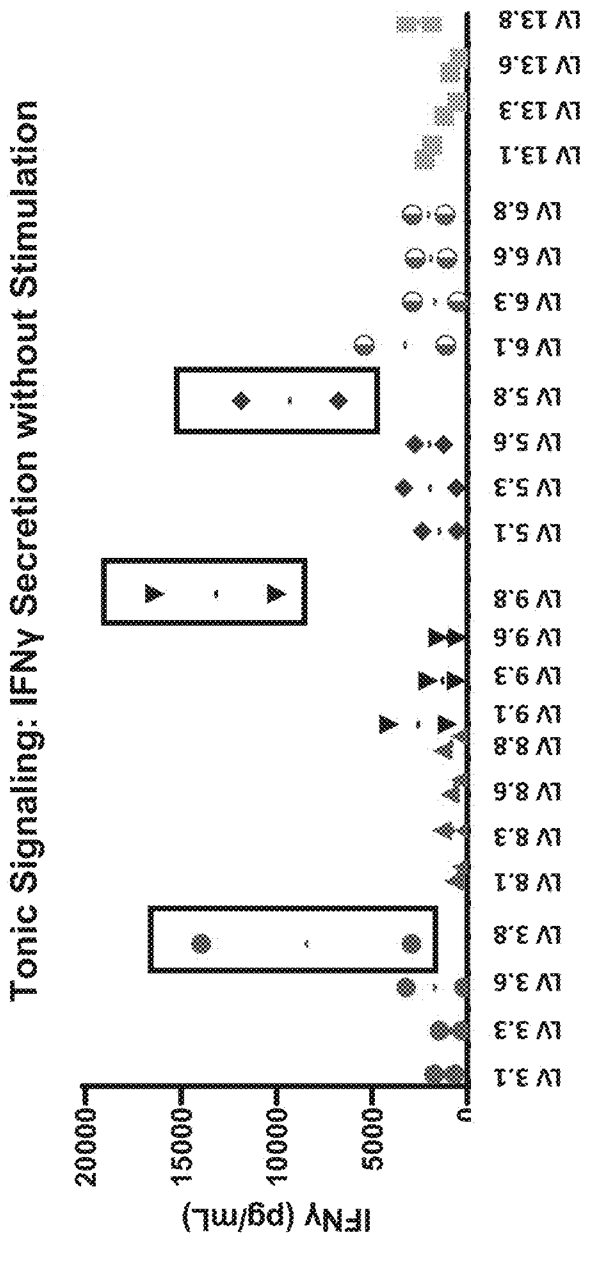
FIG. 3E shows the amount of IFNγ secreted from PBMCs expressing an anti-BCMA CAR in the absence of target cells. Human PBMCs were transduced with a recombinant lentivirus comprising a viral envelope expressing a mutated VSIV-G and a non-viral membrane-bound tropism polypeptide that binds CD3 and a lentiviral vector comprising one of the following lentiviral vector architectures, MNDU3 promoter and wild-type WPRE, MNDU3 promoter and a mutated WPRE, SFFV promoter and a mutated WPRE, and EF1α promoter and no WPRE and encoding an anti-BCMA CAR (6 anti-BCMA CARs were evaluated).

Antigen independent anti-BCMA CAR activity was assessed by culturing $5\times10^4$ transduced PBMCs in the absence of target cells for 24 hours. After 24 hours, the supernatants were harvested and IFNγ levels measures using an MSD assay. IFNγ levels were plotted against lentiviral architectures used to express the anti-BCMA CARs. FIG. 3E.

These data indicate that combinations of different lentiviral architectures and anti-BCMA CARs can be selected to modulate anti-BCMA CAR expression and activity. Further, the data show that PBMCs expressing the anti-BCMA CARs set forth in SEQ ID NOs: 259, 263, 266, 270, 273, and 277 show comparable or increased cell expansion and comparable or increased activity compared to the control anti-BCMA CAR and that only three combinations showed high levels of antigen independent (tonic) signaling.

Off-Target Transduction

Off-target transduction of multiple myeloma cells was evaluated in two BCMA-expressing multiple myeloma cell lines, RPMI-8226 cells and KMS-11 cells. $1\times10^5$ RPMI-8226 or $1\times10^5$ KMS-11 cells were plated in each well of a 96-well plate and treated at an MOI of 1 with recombinant lentiviruses listed in Table 11 that have the following lentiviral vector architectures, MNDU3 promoter and wild-type WPRE, MNDU3 promoter and a mutated WPRE, SFFV promoter and a mutated WPRE, and EF1α promoter and no WPRE; LV 19; and with LV 20. LV 20 is a recombinant lentiviral particle comprising a viral envelope that expresses a non-viral membrane bound tropism molecule comprising an anti-CD3 scFv fused to a CD8α hinge and transmembrane domain; a mutant VSIV-G fusogen comprising K47Q and R354A amino acid substitutions; and a lentiviral vector comprising an MNDU3 promoter (SEQ ID NO: 950), operably linked to a polynucleotide encoding a CD8α signal peptide and GFP and a wild-type WPRE (SEQ ID NO: 945) operably linked to the 3' end of the polynucleotide encoding GFP.

Three days post-treatment, the cells were passaged. Seven days post-treatment, the cells were harvested and genomic DNA was isolated and purified for a qPCR assay to determine vector integration using VCN. VCN values for anti-BCMA CARs were normalized to VCN for LV 20, which expresses GFP rather than an anti-BCMA CAR.

Figure 3F:
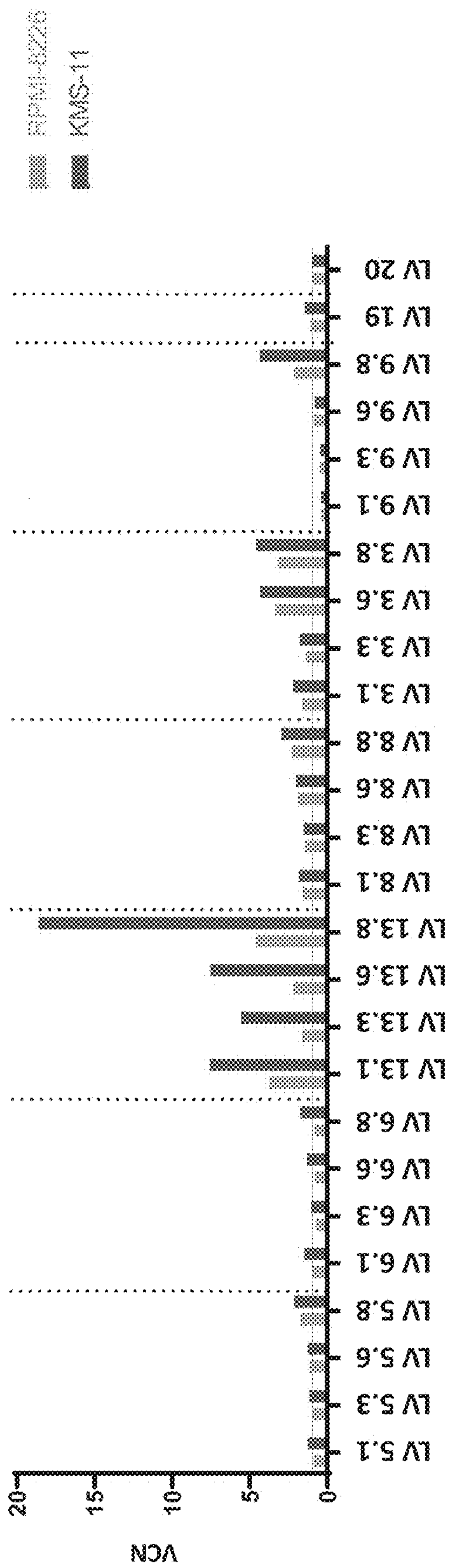
FIG. 3F shows the levels of off-target transduction in BCMA expressing cells (RPMI-8226 and KMS-11) of recombinant lentiviruses comprising a viral envelope expressing a mutated VSIV-G and a non-viral membrane-bound tropism polypeptide that binds CD3 and a lentiviral vector comprising one of the following lentiviral vector architectures, MNDU3 promoter and wild-type WPRE, MNDU3 promoter and a mutated WPRE, SFFV promoter and a mutated WPRE, and EF1α promoter and no WPRE and encoding an anti-BCMA CAR (6 anti-BCMA CARs were evaluated). Transduction was normalized to VCN in cells transduced with a recombinant lentivirus encoding GFP in place of an anti-BCMA CAR.

The data show that differences in off-target multiple myeloma transduction were largely driven by the particular anti-BCMA CAR being expressed, rather than any particular lentiviral vector architecture. Several architectures used to express the anti-BCMA CARs in LV 3, LV 5, LV 6, LV 8, and LV 9 showed low levels of off-target transduction that were comparable to or less than LV 19, which expresses a control anti-BCMA CAR. In contrast, LV 13 exhibited the highest rates of off-target transduction compared to other LVs. FIG. 3F.

Example 3

In Vivo Administered Lentivirus Demonstrates Anti-Tumor Efficacy in a Multiple Myeloma Mouse Model The anti-tumor efficacy of in vivo administered recombinant lentiviral particles comprising an envelope that expresses an anti-CD3-based tropism molecule and a mutant VSIV-G fusogen and a lentiviral vector encoding an anti-BCMA CAR was investigated in multiple myeloma mouse models.

Recombinant lentivirus for in vivo administration was produced by transient transfection of HEK293T cells with plasmids encoding a non-viral membrane bound tropism molecule comprising an anti-CD3 scFv fused to a CD8α hinge and transmembrane domain; a mutant VSIV-G fusogen comprising K47Q and R354A amino acid substitutions; lentiviral GAG/POL; lentiviral REV; and a transfer plasmid encoding a lentiviral vector comprising: (i) an MNDU3 promoter (SEQ ID NO: 950) operably linked to a polynucleotide encoding a CD8α signal peptide and an anti-BCMA CAR, and a wild-type WPRE (SEQ ID NO: 945) operably linked to the 3' end of the polynucleotide encoding the anti-BCMA CAR; (ii) an MNDU3 promoter (SEQ ID NO: 950) operably linked to a polynucleotide encoding a CD8α signal peptide and an anti-BCMA CAR, and a mutated WPRE (SEQ ID NO: 946) operably linked to the 3' end of the polynucleotide encoding the anti-BCMA CAR; (iii) an SFFV promoter (SEQ ID NO: 952) operably linked to a polynucleotide encoding a CD8α signal peptide and an anti-BCMA CAR, and a mutated WPRE (SEQ ID NO: 946) operably linked to the 3' end of the polynucleotide encoding the anti-BCMA CAR; or (iv) an EF1α promoter (SEQ ID NO: 949) operably linked to a polynucleotide encoding a CD8α signal peptide and an anti-BCMA CAR without a PRE.

The recombinant lentivirus reference number, the SEQ ID NO of the anti-BCMA CAR polypeptide and the corresponding lentiviral architectures shown in Table 12 were used in this Example.

TABLE 12

| Ref. | SEQ ID NO. | Promoter | WPRE |
|---|---|---|---|
| LV 3.1 | 261 | MNDU3 | wild-type |
| LV 3.3 | 261 | MNDU3 | mutant WPRE |
| LV 3.6 | 261 | SFFV | mutant WPRE |
| LV 3.8 | 261 | EF1α | no PRE |
| LV 5.1 | 357 | MNDU3 | wild-type |
| LV 5.3 | 357 | MNDU3 | mutant WPRE |
| LV 5.6 | 357 | SFFV | mutant WPRE |
| LV 5.8 | 357 | EF1α | no PRE |
| LV 6.1 | 429 | MNDU3 | wild-type |

TABLE 12-continued

| Ref. | SEQ ID NO. | Promoter | WPRE |
|---|---|---|---|
| LV 6.3 | 429 | MNDU3 | mutant WPRE |
| LV 6.6 | 429 | SFFV | mutant WPRE |
| LV 6.8 | 429 | EF1α | no PRE |
| LV 8.1 | 525 | MNDU3 | wild-type |
| LV 8.3 | 525 | MNDU3 | mutant WPRE |
| LV 8.6 | 525 | SFFV | mutant WPRE |
| LV 8.8 | 525 | EF1α | no PRE |
| LV 9.1 | 597 | MNDU3 | wild-type |
| LV 9.3 | 597 | MNDU3 | mutant WPRE |
| LV 9.6 | 597 | SFFV | mutant WPRE |
| LV 9.8 | 597 | EF1α | no PRE |
| LV 13.1 | 693 | MNDU3 | wild-type |
| LV 13.3 | 693 | MNDU3 | mutant WPRE |
| LV 13.6 | 693 | SFFV | mutant WPRE |
| LV 13.8 | 693 | EF1α | no PRE |

Ex vivo anti-BCMA CAR T cells were also prepared. Briefly, HEK293T cells were transiently transfected with plasmids encoding a wild-type VSIV-G fusogen; lentiviral GAG/POL; lentiviral REV; and a transfer plasmid encoding a lentiviral vector comprising an MNDU3 promoter operable linked to a CD8α signal peptide and a control anti-BCMA CAR obtained from the literature (SEQ ID NO: 954), and a wild-type WPRE (SEQ ID NO: 945) operably linked to the 3' end of the polynucleotide encoding the anti-BCMA CAR. PBMCs were then transduced with the recombinant lentivirus and cultured for 7 days to generate anti-BCMA CAR T cells.

First Daudi Model Study

NSG mice were intravenously injected with $2\times10^6$ Daudi cells labeled with firefly luciferase. After four days, four out of five groups of mice were intravenously administered $1\times10^6$ human PBMCs. The next day mice that received the $1\times10^6$ human PBMCs were administered vehicle control (DMEM); or $2.2\times10^8$ IU of LV 3.1, LV 6.1, LV 8.1, or LV 13.1. Mice that were not administered PBMCs were administered $5\times10^6$ ex vivo anti-BCMA CAR T cells. All groups of mice then received three doses of $2\times10^5$ IU recombinant human IL-2 at 6, 24, and 48 hours post LV administration. Tumor volume was measured by using a bioluminescence imaging system.

Figure 4A:
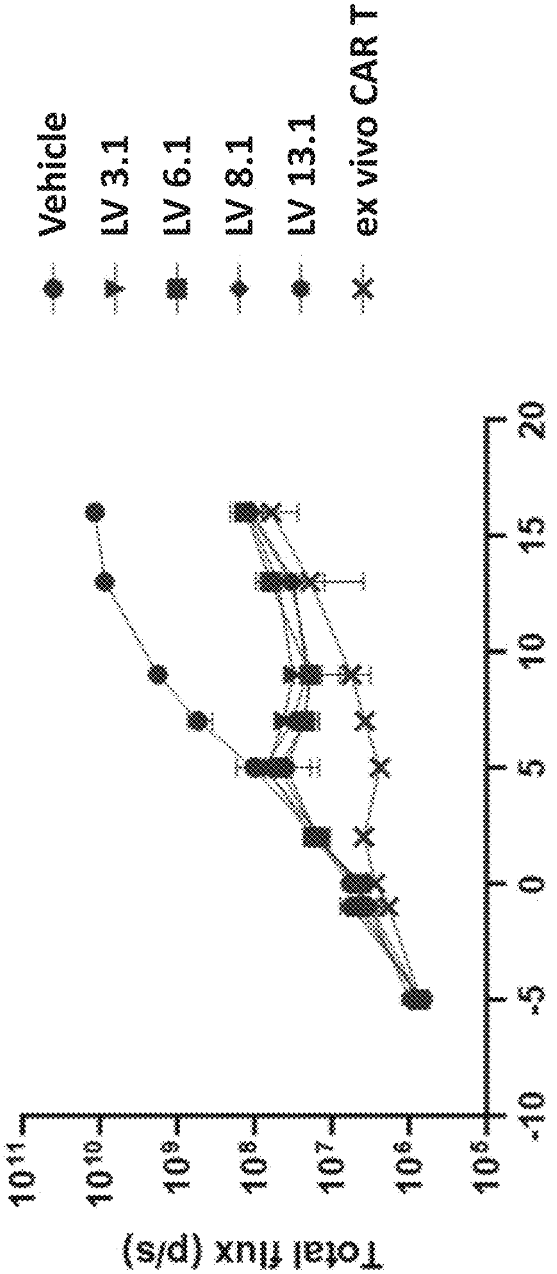
FIG. 4A shows the results from an in vivo Daudi mouse model. Mice were administered a recombinant lentivirus comprising a viral envelope expressing a mutated VSIV-G and a non-viral membrane-bound tropism polypeptide that binds CD3 and a lentiviral vector encoding either an MNDU3 promoter operably linked to a polynucleotide encoding a CD8α signal peptide and an anti-BCMA CAR (4 anti-BCMA CARs were evaluated) and a wild-type WPRE operably linked to the 3' prime end of the polynucleotide encoding the anti-BCMA CAR; ex vivo CAR T cells, or vehicle.

Tumor size increased in mice treated with vehicle. Mice treated with ex vivo anti-BCMA CAR T cells and in vivo with LV anti-BCMA CAR experienced tumor regression. FIG. 4A.

Second Daudi Model Study

NSG mice were intravenously injected with $2\times10^6$ Daudi cells labeled with firefly luciferase. After four days, eight out of nine groups of mice were intravenously administered $1\times10^6$ human PBMCs. The next day mice that received the $1\times10^6$ human PBMCs were administered vehicle control (DMEM); $1.25\times10^8$ IU of LV 3.1, LV 6.1, LV 6.3, LV 8.1, LV 9.3, LV 9.6, or LV 13.8; or $5.6\times10^7$ IU of LV 6.8. Mice that were not administered PBMCs were administered $5\times10^6$ ex vivo anti-BCMA CAR T cells. All groups of mice then received three doses of $2\times10^5$ IU recombinant human IL-2 at 6, 24, and 48 hours post LV administration. Tumor volume was measured by using a bioluminescence imaging system.

Figure 4B:
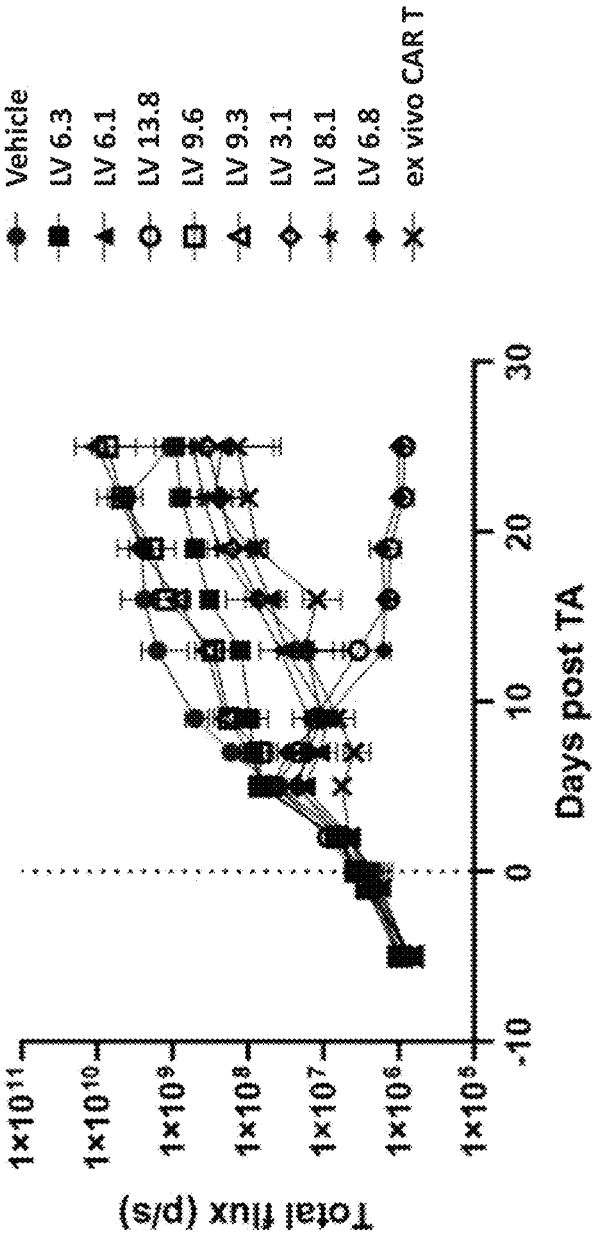
FIG. 4B shows the results from an in vivo Daudi mouse model. Mice were administered a recombinant lentivirus comprising a viral envelope expressing a mutated VSIV-G and a non-viral membrane-bound tropism polypeptide that binds CD3 and a lentiviral vector comprising one of the following lentiviral vector architectures, MNDU3 promoter and wild-type WPRE, MNDU3 promoter and a mutated WPRE, SFFV promoter and a mutated WPRE, and EF1α promoter and no WPRE and encoding an anti-BCMA CAR (5 anti-BCMA CARs were evaluated); ex vivo CAR T cells, or vehicle.

Tumor size increased in mice treated with vehicle. Mice treated with ex vivo anti-BCMA CAR T cells and in vivo with some LV anti-BCMA CARs experienced mild control of tumor growth, whereas LV 6.8 and LV 13.8 experienced durable tumor regression. FIG. 4B.

Third Daudi Model Study

NSG mice were intravenously injected with $2\times10^6$ Daudi cells labeled with firefly luciferase. After four days, eight out of nine groups of mice were intravenously administered $1\times10^6$ human PBMCs. The next day mice that received the $1\times10^6$ human PBMCs were administered vehicle control (DMEM); $1.25\times10^8$ IU of LV 3.3, LV 3.6, LV 8.3, LV 8.6, LV 8.8, LV 13.3, or LV 13.6; or $5.6\times10^7$ IU of LV 6.8. Mice that were not administered PBMCs were administered $5\times10^6$ ex vivo anti-BCMA CAR T cells. All groups of mice then received three doses of $2\times10^5$ IU recombinant human IL-2 at 6, 24, and 48 hours post LV administration. Tumor volume was measured by using a bioluminescence imaging system.

Figure 4C:
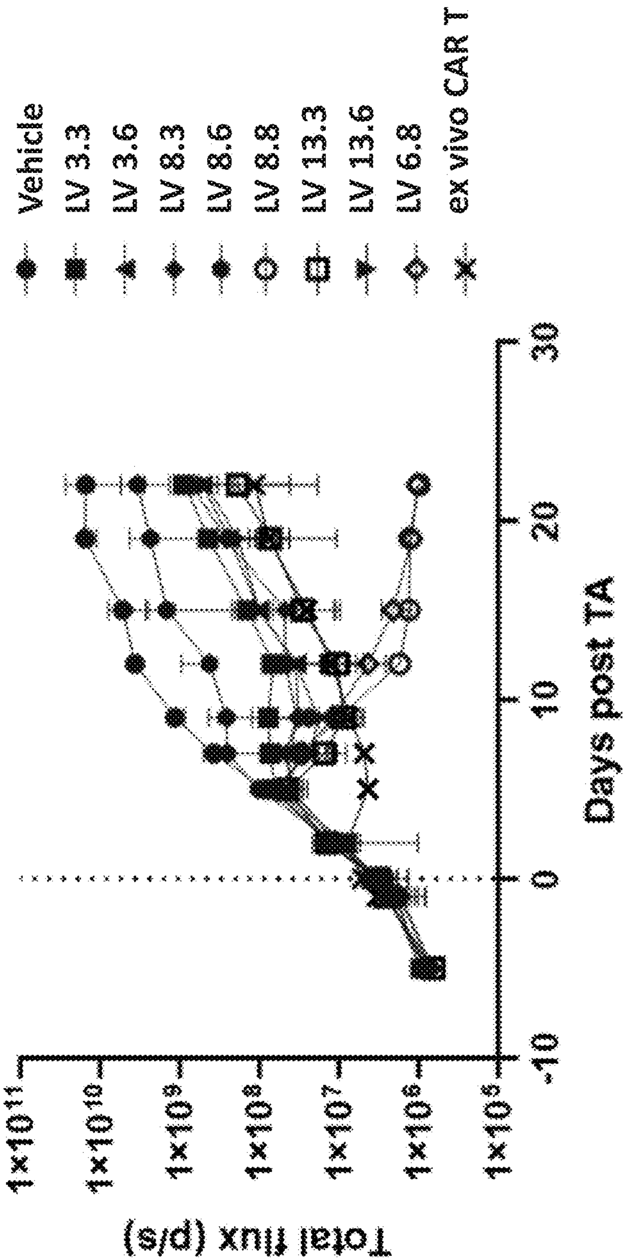
FIG. 4C shows the results from an in vivo Daudi mouse model. Mice were administered a recombinant lentivirus comprising a viral envelope expressing a mutated VSIV-G and a non-viral membrane-bound tropism polypeptide that binds CD3 and a lentiviral vector comprising one of the following lentiviral vector architectures, MNDU3 promoter and a mutated WPRE, SFFV promoter and a mutated WPRE, and EF1α promoter and no WPRE and encoding an anti-BCMA CAR (4 anti-BCMA CARs were evaluated); ex vivo CAR T cells, or vehicle.

Tumor size increased in mice treated with vehicle. Mice treated with ex vivo anti-BCMA CAR T cells and in vivo with some LV anti-BCMA CARs experienced mild control of tumor growth, whereas LV 6.8 and LV 8.8 experienced durable tumor regression. FIG. 4C.

First RPMI Model Study

NOD scid gamma (NSG) mice were subcutaneously injected with $1\times10^6$ RPMI-8226 cells (a BCMA positive tumor cell line). Tumors were allowed to grow to a size of about 110 $mm^3$ to 140 $mm^3$ (about two and a half weeks).

Five out of six groups of mice were then intravenously administered $1\times10^6$ human PBMCs. The next day, mice that received the $1\times10^6$ human PBMCs were administered vehicle control (DMEM); $5.0\times10^7$ IU of LV 6.3, LV 6.8, LV 8.3, or LV 8.8. The sixth group of mice was administered $2\times10^6$ unmodified ex vivo anti-BCMA CAR T cells. All groups of mice then received three doses of $2\times10^5$ IU recombinant human IL-2 at 6, 24, and 48 hours post LV administration. Tumor volume was measured externally using calipers and mice were euthanized at pre-determined humane endpoints based on tumor size and body condition.

Figure 4D:
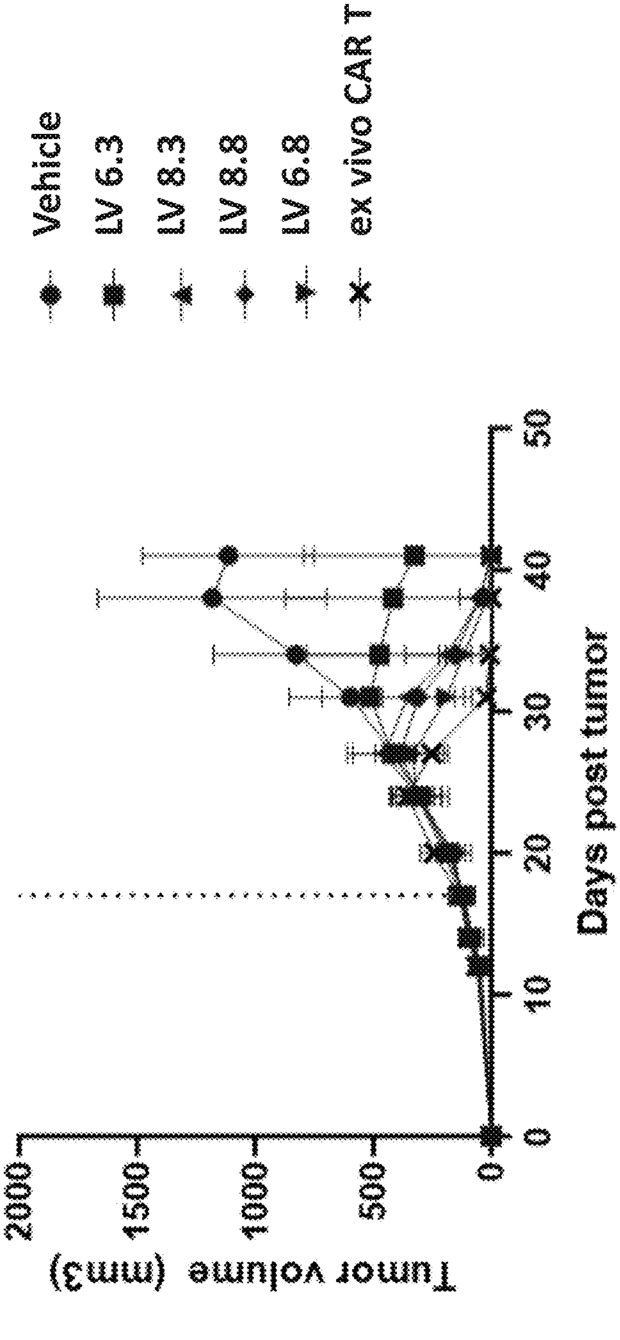
FIG. 4D shows the results from an in vivo RPMI-8226 mouse model. Mice were administered a recombinant lentivirus comprising a viral envelope expressing a mutated VSIV-G and a non-viral membrane-bound tropism polypeptide that binds CD3 and a lentiviral vector comprising one of the following lentiviral vector architectures, MNDU3 promoter and a mutated WPRE, or EF1α promoter and no WPRE and encoding an anti-BCMA CAR (2 anti-BCMA CARs were evaluated); ex vivo CAR T cells, or vehicle.

Tumor size increased in mice treated with vehicle control. Mice treated with LV 6.3 experienced moderate tumor regression, whereas mice treated with ex vivo anti-BCMA CAR T cells or in vivo with LV 6.8, LV 8.3, or LV 8.8 experienced complete and durable tumor regression. FIG. 4D.

Mice that were not administered PBMCs were administered $5\times10^6$ ex vivo anti-BCMA CAR T cells. All groups of mice then received three doses of $2\times10^5$ IU recombinant human IL-2 at 6, 24, and 48 hours post LV administration.

Second RPMI Model Study

NOD scid gamma (NSG) mice were subcutaneously injected with $1\times10^6$ RPMI-8226 cells (a BCMA positive tumor cell line). Tumors were allowed to grow to a size of about 110 $mm^3$ to 140 $mm^3$ (about two and a half weeks).

Four out of five groups of mice were then intravenously administered $1\times10^6$ human PBMCs. The next day, mice that received the $1\times10^6$ human PBMCs were administered vehicle control (DMEM); $1.25\times10^7$ IU of LV 6.8, $5.0\times10^7$ IU of LV 6.8, or $1.25\times10^8$ IU of LV 6.8. The fifth group of mice was administered $2\times10^6$ unmodified ex vivo anti-BCMA CAR T cells. All groups of mice then received three doses of $2\times10^5$ IU recombinant human IL-2 at 6, 24, and 48 hours post LV administration. Tumor volume was measured externally using calipers and mice were euthanized at pre-determined humane endpoints based on tumor size and body condition.

Figure 4E:
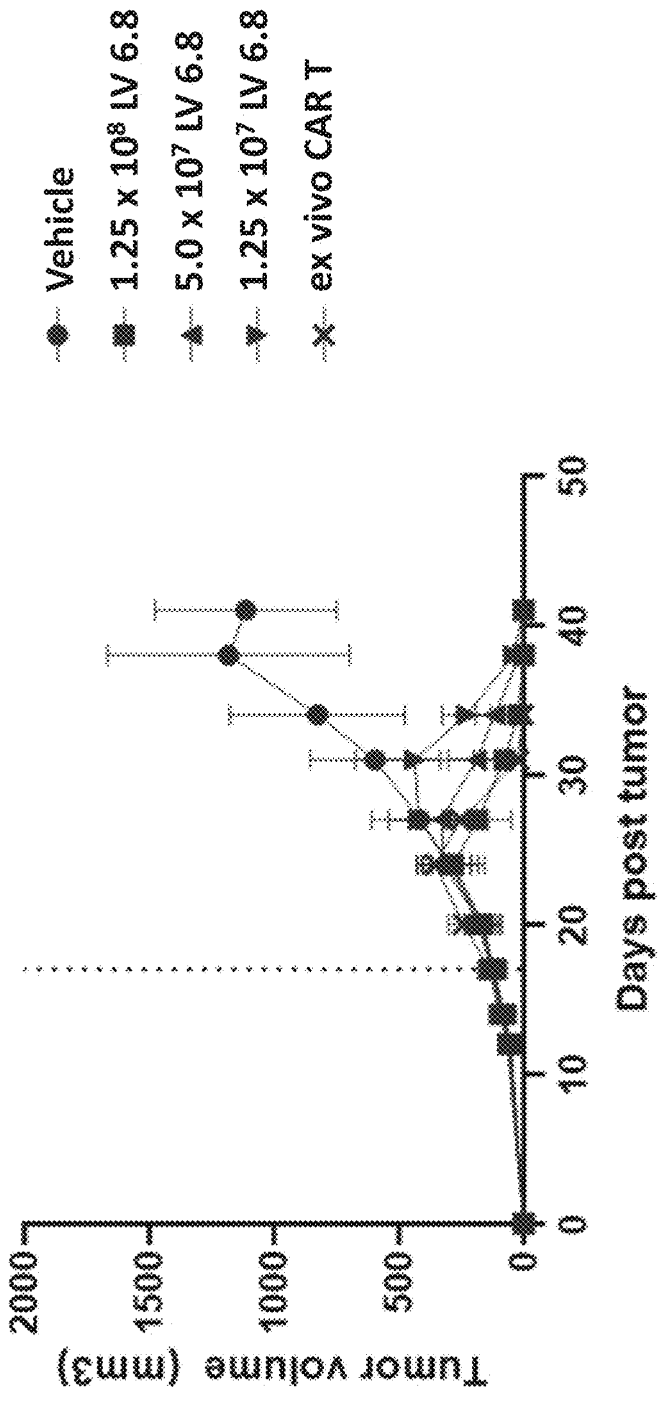
FIG. 4E shows the results from an in vivo RPMI-8226 mouse model. Mice were administered three doses ($1.25\times10^7$ IU, $5.0\times10^7$ IU, or $1.25\times10^8$ IU) of a recombinant lentivirus comprising a viral envelope expressing a mutated VSIV-G and a non-viral membrane-bound tropism polypeptide that binds CD3 and a lentiviral vector comprising an EF1α promoter operably linked to a polynucleotide encoding an anti-BCMA CAR without a PRE; ex vivo CAR T cells, or vehicle.

Tumor size increased in mice treated with vehicle control. Mice treated with all three doses of LV 6.8 experienced dose-dependent but complete and durable tumor regression. Mice treated with ex vivo anti-BCMA CAR T cells also experienced complete and durable tumor regression. FIG. 4E.

Third RPMI Model Study

NOD scid gamma (NSG) mice were subcutaneously injected with $1\times10^6$ RPMI-8226 cells (a BCMA positive tumor cell line). Tumors were allowed to grow to a size of about 110 $mm^3$ to 140 $mm^3$ (about two and a half weeks).

Three out of four groups of mice were then intravenously administered $1\times10^6$ human PBMCs. The next day, mice that received the $1\times10^6$ human PBMCs were administered vehicle control (DMEM); $5.0\times10^7$ IU of LV 6.3 or $1.25\times10^8$ IU of LV 6.3. The fourth group of mice was administered $2\times10^6$ unmodified ex vivo anti-BCMA CAR T cells. All groups of mice then received three doses of $2\times10^5$ IU recombinant human IL-2 at 6, 24, and 48 hours post LV administration. Tumor volume was measured externally using calipers and mice were euthanized at pre-determined humane endpoints based on tumor size and body condition.

Figure 4F:
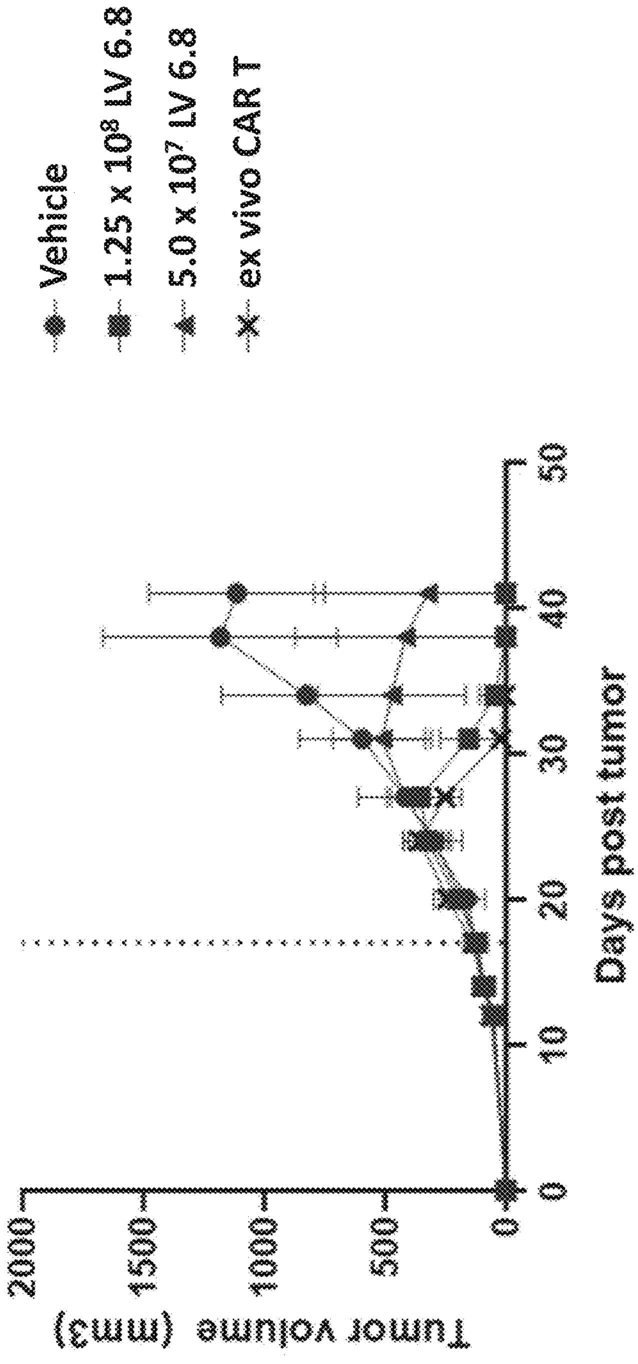
FIG. 4F shows the results from an in vivo RPMI-8226 mouse model. Mice were administered two doses ($5.0\times10^7$ IU or $1.25\times10^8$ IU) of a recombinant lentivirus comprising a viral envelope expressing a mutated VSIV-G and a non-viral membrane-bound tropism polypeptide that binds CD3 and a lentiviral vector comprising an EF1α promoter operably linked to a polynucleotide encoding an anti-BCMA CAR without a PRE; ex vivo CAR T cells, or vehicle.

Tumor size increased in mice treated with vehicle control. Mice treated with both doses of LV 6.3 experienced dose-dependent tumor regression. Mice treated with ex vivo anti-BCMA CAR T cells experienced complete and durable tumor regression. FIG. 4F.

Fourth Daudi Model Study

NSG mice were intravenously injected with $2\times10^6$ Daudi cells labeled with firefly luciferase. After four days, four out of five groups of mice were intravenously administered $1\times10^6$ human PBMCs. The next day mice that received the $1\times10^6$ human PBMCs were administered vehicle control (DMEM); $1.25\times10^8$ IU of LV 6.1 or LV6.3; or $5.6\times10^7$ IU of LV 6.8. Mice that were not administered PBMCs were administered $5\times10^6$ ex vivo anti-BCMA CAR T cells. All groups of mice then received three doses of $2\times10^5$ IU recombinant human IL-2 at 6, 24, and 48 hours post LV administration. Tumor volume was measured by using a bioluminescence imaging system.

Figure 4G:
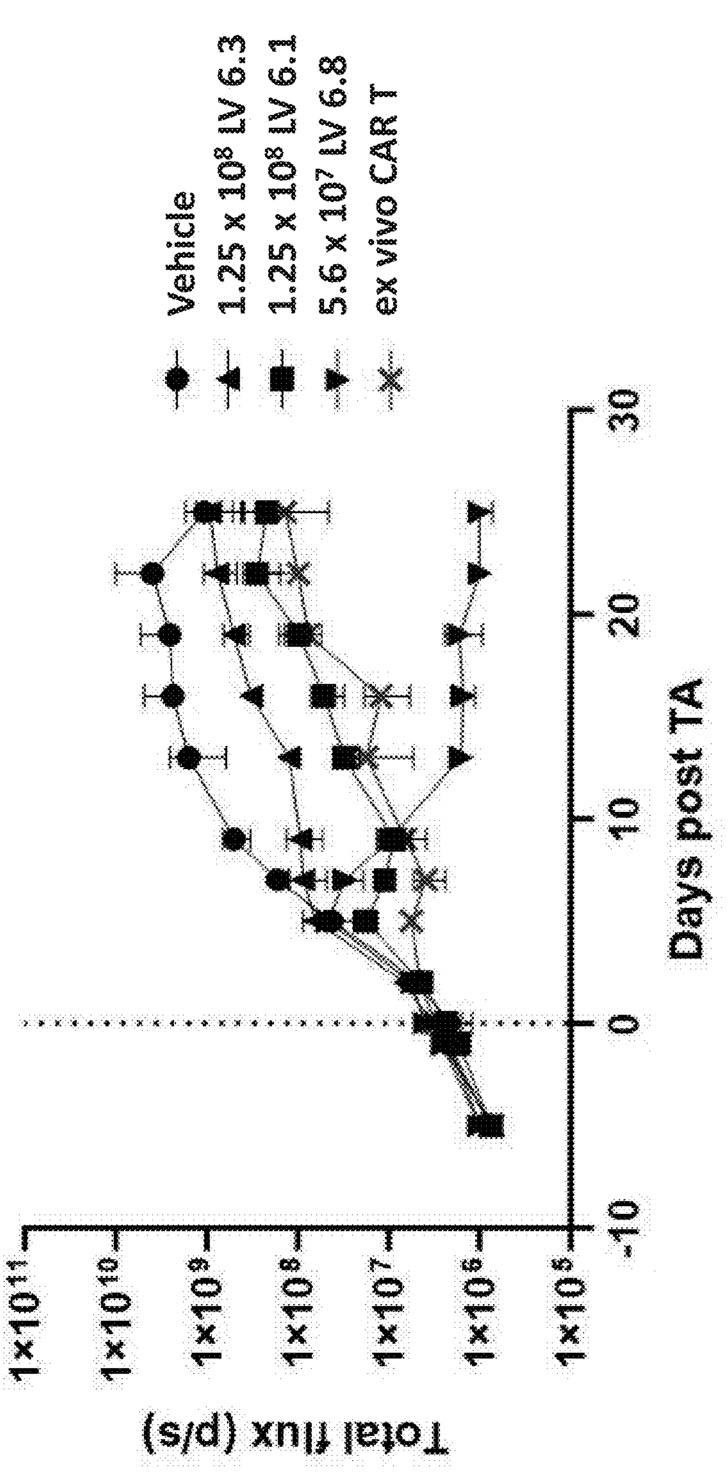
FIG. 4G shows the results from an in vivo Daudi mouse model. Mice were administered a recombinant lentivirus comprising a viral envelope expressing a mutated VSIV-G and a non-viral membrane-bound tropism polypeptide that binds CD3 and a lentiviral vector encoding an anti-BCMA CAR and comprising one of the following lentiviral vector architectures, MNDU3 promoter and a mutated WPRE or MNDU3 promoter and a mutated WPRE (at $1.25\times10^8$ IU) or an EF1α promoter and no WPRE ($5.6\times10^7$ IU); ex vivo CAR T cells, or vehicle.

Tumor size increased in mice treated with vehicle. Mice treated with ex vivo anti-BCMA CAR T cells and in vivo with LV 6.1 and LV 6.3 experienced mild control of tumor growth, whereas LV 6.8 experienced complete and durable tumor regression. FIG. 4G.

Example 4

Comparative Anti-Tumor Efficacy in a Multiple Myeloma Mouse Model in Both In Vivo and Ex Vivo Formats The anti-tumor efficacy of recombinant lentiviral particles comprising an envelope that expresses an anti-CD3-based tropism molecule and a mutant VSIV-G fusogen and a lentiviral vector encoding various anti-BCMA CARs was investigated in multiple myeloma mouse models. The recombinant lentiviruses were formulated as in vivo administered lentiviral particles and were also used to manufacture ex vivo anti-BCMA CAR T cells.

Recombinant lentivirus was produced by transient transfection of HEK293T cells with plasmids encoding a non-viral membrane bound tropism molecule comprising an anti-CD3 scFv fused to a CD8α hinge and transmembrane domain; a mutant VSIV-G fusogen comprising K47Q and R354A amino acid substitutions; lentiviral GAG/POL; lentiviral REV; and a transfer plasmid encoding a lentiviral vector encoding an anti-BCMA CAR set forth in SEQ ID NO: 429, SEQ ID NO: 954, or SEQ ID NO: 955 or a GFP control.

TABLE 13

| SEQ ID NO: | NUCLEIC ACID SEQUENCE |
|---|---|
| 954 | DIVLTQSPPSLAMSLGKRATISCRASESVTILGSHLIHWYQQKPGQPPTLLIQLASNVQTG VPARFSGSGSRTDFTLTIDPVEEDDVAVYYCLQSRTIPRTFGGGTKLEIKGSTSGSGKPGS GEGSTKGQIQLVQSGPELKKPGETVKISCKASGYTFTDYSINWVKRAPGKGLKWMGWINTE TREPAYAYDFRGRFAFSLETSASTAYLQINNLKYEDTATYFCALDYSYAMDYWGQGTSVTV SSAAATTTPAPRPPTPAPTIASQPLSLRPEACRPAAGGAVHTRGLDFACDIYIWAPLAGTC GVLLLSLVITLYCKRGRKKLLYIFKQPFMRPVQTTQEEDGCSCRFPEEEEGGCELRVKFSR SADAPAYQQGQNQLYNELNLGRREEYDVLDKRRGRDPEMGGKPRRKNPQEGLYNELQKDKM AEAYSEIGMKGERRRGKGHDGLYQGLSTATKDTYDALHMQALPPR |
| 955 | QVKLEESGGGLVQAGRSLRLSCAASEHTFSSHVMGWFRQAPGKERESVAVIGWRDISTSYA DSVKGRFTISRDNAKKTLYLQMNSLKPEDTAVYYCAARRIDAADFDSWGQGTQVTVSSGGG GSEVQLVESGGGLVQAGGSLRLSCAASGRTFTMGWFRQAPGKEREFVAAISLSPTLAYYAE SVKGRFTISRDNAKNTVVLQMNSLKPEDTALYYCAADRKSVMSIRPDYWGQGTQVTVSSTS TTTPAPRPPTPAPTIASQPLSLRPEACRPAAGGAVHTRGLDFACDIYIWAPLAGTCGVLLL SLVITLYCKRGRKKLLYIFKQPFMRPVQTTQEEDGCSCRFPEEEEGGCELRVKFSRSADAP AYQQGQNQLYNELNLGRREEYDVLDKRRGRDPEMGGKPRRKNPQEGLYNELQKDKMAEAYS EIGMKGERRRGKGHDGLYQGLSTATKDTYDALHMQALPPR |

The recombinant lentivirus reference number, the SEQ ID NO of the anti-BCMA CAR polypeptide and the corresponding lentiviral architectures shown in Table 12 were used in this Example.

TABLE 14

| Ref. | SEQ ID NO. | Promoter | WPRE |
|---|---|---|---|
| LV 6.8 | 429 | EF1α | none |
| LV A | 954 | MNDU3 | WT WPRE |
| LV B | 955 | EF1α | none |
| LV19 | GFP | MNDU3 | none |

Ex vivo anti-BCMA CAR T cells were also prepared by transducing PBMCs with the recombinant lentivirus and culturing the transduced cell for 7 days to generate anti-BCMA CAR T cells.

In Vivo Daudi Model Study

NSG mice were intravenously injected with $2\times10^6$ Daudi cells labeled with firefly luciferase. After four days, four out of five groups of mice were intravenously administered $1\times10^6$ human PBMCs. The next day, mice that did not receive PBMCs were administered vehicle control (DMEM)

and mice that received the PBMCs were administered 5.0×$10^7$ IU of LV 6.8, LV A, LV B, or LV 19 (GFP control). Tumor volume was measured by using a bioluminescence imaging system.

Figure 5A:
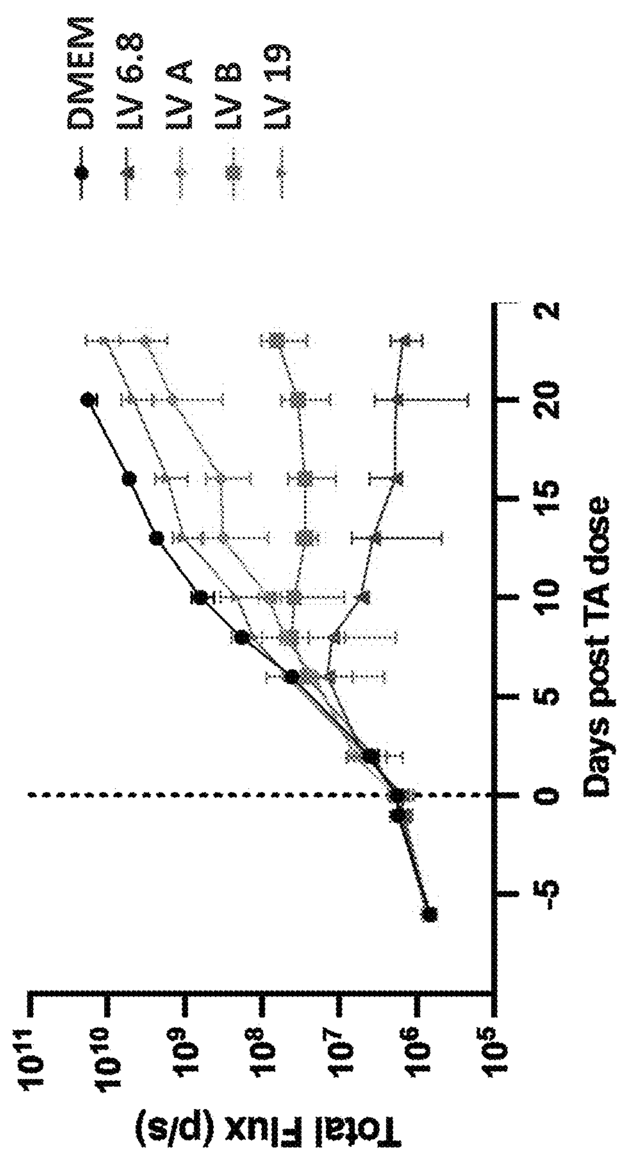
FIG. 5A shows the results from a Daudi mouse model interrogated with in vivo lentivirus. Mice were administered vehicle control or recombinant lentivirus comprising a viral envelope expressing a mutated VSIV-G and a non-viral membrane-bound tropism polypeptide that binds CD3 and a lentiviral vector encoding one of three anti-BCMA CARs or a GFP control.

Tumor size increased in mice treated with vehicle, mice treated with the GFP control, and mice treated with a lentivirus expressing an anti-BCMA CAR comprising the binding domain used in idecabtagene vicleucel. Mice treated with a lentivirus expressing an anti-BCMA CAR comprising the binding domains like those used in ciltacabtagene autoleucel experienced suppression of tumor growth. Only mice treated with an anti-BCMA CAR comprising SEQ ID NO: 429 experienced tumor regression. FIG. 5A.

Ex Vivo Daudi Model Study

NSG mice were intravenously injected with 2×$10^6$ Daudi cells labeled with firefly luciferase. After five days, three out of five groups of mice were intravenously administered 2×$10^6$ human anti-BCMA CAR T cells. Mice that did not receive anti-BCMA CAR T cells were administered vehicle control (DMEM) or 2×$10^6$ untransduced control human T cells (UTD) and mice that received the anti-BCMA CAR T cells were administered 2×$10^6$ anti-BCMA CAR T cells expressing the CAR encoded by SEQ ID NO: 429, SEQ ID NO: 954 or SEQ ID NO: 955. Tumor volume was measured by using a bioluminescence imaging system.

Figure 5B:
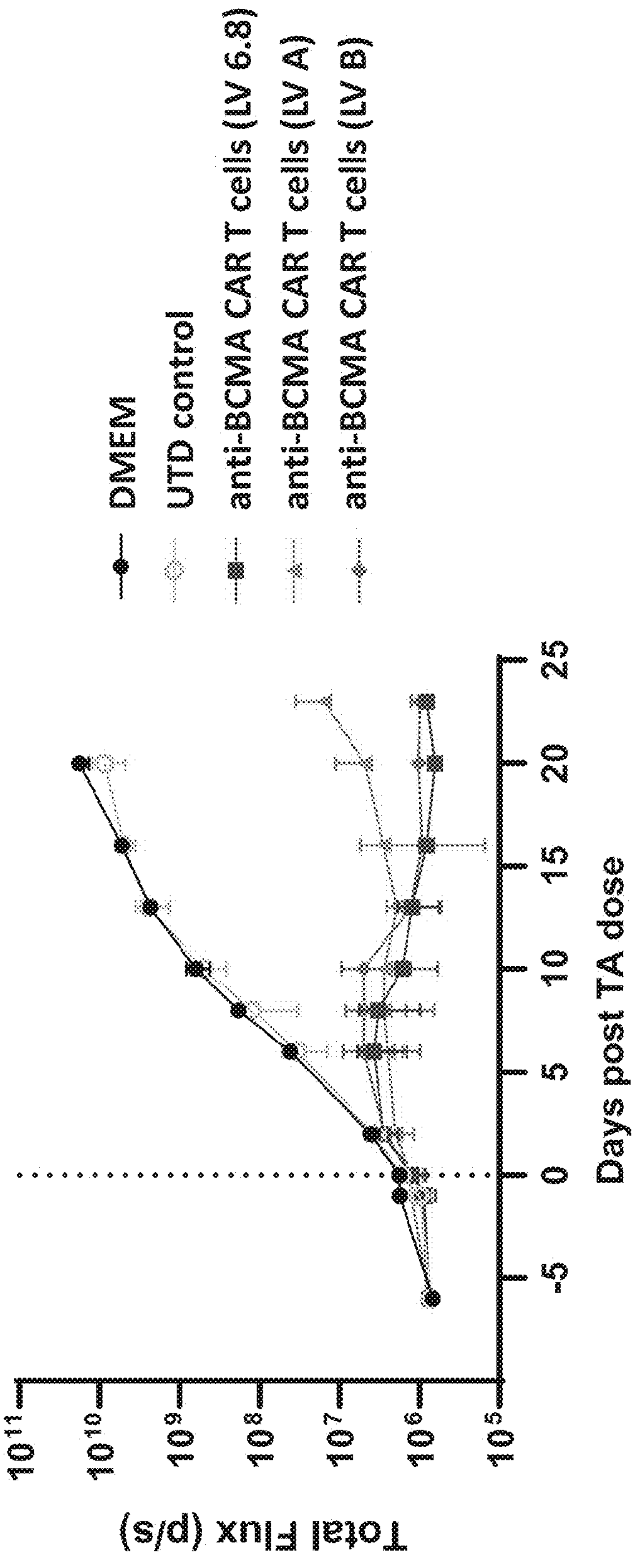
FIG. 5B shows the results from a Daudi mouse model interrogated with ex vivo manufactured CAR T cells. Mice were administered vehicle control, untransduced PBMCS, or PBMCs transduced with a recombinant lentivirus comprising a viral envelope expressing a mutated VSIV-G and a non-viral membrane-bound tropism polypeptide that binds CD3 and a lentiviral vector and encoding one of three anti-BCMA CARs.

Tumor size increased in mice treated with vehicle and with untransduced control T cells. Mice treated with CAR T cells expressing an anti-BCMA CAR comprising the binding domain used in idecabtagene vicleucel showed a transient decrease in tumor burden whereas mice treated with CAR T cells expressing an anti-BCMA CAR comprising SEQ ID NO: 429 or an anti-BCMA CAR comprising the binding domains like those used in ciltacabtagene autoleucel experienced comparable and complete tumor regression. FIG. 5B.

In general, in the following claims, the terms used should not be construed to limit the claims to the specific embodiments disclosed in the specification and the claims but should be construed to include all possible embodiments along with the full scope of equivalents to which such claims are entitled. Accordingly, the claims are not limited by the disclosure.

group consisting of: TGEKP (SEQ ID NO: 2); $(GGGGS)_n$ wherein n=1, 2, 3, 4 or 5 (SEQ ID NOs: 3, 976-979); EGKSSGSGSESKVD (SEQ ID NO: 4); KESGSVSSEQLAQFRSLD (SEQ ID NO: 5); LRQRDGERP (SEQ ID NO: 6); LRQKDGGGSERP (SEQ ID NO: 7); LRQKD (GGGS) 2ERP (SEQ ID NO: 8), GEGTSTGSGGSGGSGGAD (SEQ ID NO: 9), and GSTSGSGKPGSGEGSTKG (SEQ ID NO: 10) and variants thereof comprising an amino acid sequence 95% identical thereto.

3. The antibody or antigen binding fragment thereof of claim 1, wherein the VH comprises the amino acid sequence set forth in SEQ ID NO: 61 and the VL comprises the amino acid sequence set forth in SEQ ID NO: 65.

4. The antibody or antigen binding fragment thereof of claim 1, wherein the antibody or antigen binding fragment thereof comprises the amino acid sequence set forth in SEQ ID NO: 69 or 70.

5. A bispecific antibody comprising the antibody or antigen binding fragment thereof of claim 1.

6. The bispecific antibody of claim 5, further comprising an anti-CD3 antibody that binds CD3δ, CD3ε, CD3γ, or CD3ζ.

7. An antibody conjugate comprising the antibody or antigen binding fragment thereof of claim 1 conjugated to a cytotoxic agent.

8. The antibody conjugate of claim 7, wherein:

(a) the cytotoxic agent is a toxin selected from the group consisting of: saporin, diphtheria toxin, *pseudomonas* exotoxin A, Ricin A chain derivatives, a small molecule toxin, and combinations thereof;

(b) the cytotoxic agent is a radioisotope selected from the group consisting of: 131I, 90Y, 177Lu, 188Re, 67Cu, 213Bi, 211At, and 227Ac;

(c) the cytotoxic agent is an RNA polymerase II inhibitor and/or RNA polymerase III inhibitor selected from the group consisting of: an amatoxin, α-amanitin, β-amanitin, γ-amanitin, ε-amanitin, amanin, amaninamide, amanullin, amanullinic acid and any functional fragments, derivatives or analogs thereof, or (d) the cytotoxic agent is a DNA-damaging agent selected from the group consisting of: an antitubulin agent, a DNA crosslinking agent, a DNA alkylating agent and a mitotic disrupting agent.

SEQUENCE LISTING (980 sequences)

SEQ ID NO: 1 - protein, 184 aa, Homo sapiens
MLQMAGQCSQNEYFDSLLHACIPCQLRCSSNTPPLTCQRYCNASVTNSVKGTNAILWTCLGLSLIISLAVFVLMFLLRKINSEPLKDEFKNTGSGLLGMANIDLEKSRTGDEIILPRGLEYTVEECTCEDCIKSKPKVDSDHCFPLPAMEEGATILVTTKTNDYCKSLPAALSATEIEKSISAR

SEQ ID NO: 2 - protein, 5 aa, synthetic construct
TGEKP

SEQ ID NO: 3 - protein, 5 aa, synthetic construct
GGGGS

SEQ ID NO: 4 - protein, 14 aa, synthetic construct
EGKSSGSGSESKVD

SEQ ID NO: 5 - protein, 18 aa, synthetic construct
KESGSVSSEQLAQFRSLD

SEQ ID NO: 6 - protein, 9 aa, synthetic construct
LRQRDGERP

SEQ ID NO: 7 - protein, 12 aa, synthetic construct
LRQKDGGGSERP

SEQ ID NO: 8 - protein, 16 aa, synthetic construct
LRQKDGGGSGGGSERP

SEQ ID NO: 9 - protein, 18 aa, synthetic construct
GEGTSTGSGGSGGSGGAD

SEQ ID NO: 10 - protein, 18 aa, synthetic construct
GSTSGSGKPGSGEGSTKG

SEQ ID NO: 11 - protein, 118 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSS

SEQ ID NO: 12 - protein, 7 aa, synthetic construct
TSGVGVG

SEQ ID NO: 13 - protein, 16 aa, synthetic construct
LIYWNDEKRYSPSLKS

SEQ ID NO: 14 - protein, 8 aa, synthetic construct
DEYGGFDI

SEQ ID NO: 15 - protein, 107 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIK

SEQ ID NO: 16 - protein, 11 aa, synthetic construct
RASQSVSSYLA

SEQ ID NO: 17 - protein, 7 aa, synthetic construct
DASNRAT

SEQ ID NO: 18 - protein, 9 aa, synthetic construct
QQRVVYPIT

SEQ ID NO: 19 - protein, 245 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIK

SEQ ID NO: 20 - protein, 245 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSS

SEQ ID NO: 21 - protein, 118 aa, synthetic construct
QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSS

SEQ ID NO: 22 - protein, 7 aa, synthetic construct
TSGVGVG

SEQ ID NO: 23 - protein, 16 aa, synthetic construct
LIYWNDDKRYSPSLKS

SEQ ID NO: 24 - protein, 8 aa, synthetic construct
DEYGGFDI

SEQ ID NO: 25 - protein, 107 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIK

SEQ ID NO: 26 - protein, 11 aa, synthetic construct
RASQSVSSYLA

SEQ ID NO: 27 - protein, 7 aa, synthetic construct
DASNRAT

SEQ ID NO: 28 - protein, 9 aa, synthetic construct
QQRFDYPIT

SEQ ID NO: 29 - protein, 245 aa, synthetic construct
QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIK

SEQ ID NO: 30 - protein, 245 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKGGGGSGGGGSGGGGSGGGGSQITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSS

SEQ ID NO: 31 - protein, 117 aa, synthetic construct
QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSS

SEQ ID NO: 32 - protein, 5 aa, synthetic construct
SYGMH

SEQ ID NO: 33 - protein, 17 aa, synthetic construct
VISYEGSNKYYADSVKG

SEQ ID NO: 34 - protein, 8 aa, synthetic construct
ELGDGMDV

SEQ ID NO: 35 - protein, 106 aa, synthetic construct
EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIK

SEQ ID NO: 36 - protein, 11 aa, synthetic construct
RASQSVSSYLA

SEQ ID NO: 37 - protein, 7 aa, synthetic construct
DASNRAT

SEQ ID NO: 38 - protein, 8 aa, synthetic construct
QQRVDLWT

SEQ ID NO: 39 - protein, 243 aa, synthetic construct
QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSGGGGSGGGGSGGGGSGGGGSEIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIK

SEQ ID NO: 40 - protein, 243 aa, synthetic construct
EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSS

SEQ ID NO: 41 - protein, 118 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSS

SEQ ID NO: 42 - protein, 5 aa, synthetic construct
DYYMS

SEQ ID NO: 43 - protein, 17 aa, synthetic construct
YISSSGSTIYYADSVKG

SEQ ID NO: 44 - protein, 9 aa, synthetic construct
DQGNYGVDV

SEQ ID NO: 45 - protein, 107 aa, synthetic construct
DIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIK

SEQ ID NO: 46 - protein, 11 aa, synthetic construct
RASQSISSWLA

SEQ ID NO: 47 - protein, 7 aa, synthetic construct
DASSLES

SEQ ID NO: 48 - protein, 9 aa, synthetic construct
QQVSSLPPT

SEQ ID NO: 49 - protein, 245 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIK

SEQ ID NO: 50 - protein, 245 aa, synthetic construct
DIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSS

SEQ ID NO: 51 - protein, 118 aa, synthetic construct
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSS

SEQ ID NO: 52 - protein, 5 aa, synthetic construct
DYYMS

SEQ ID NO: 53 - protein, 17 aa, synthetic construct
YISSSGSTIYYADSVKG

SEQ ID NO: 54 - protein, 9 aa, synthetic construct
DQGNYGVDV

SEQ ID NO: 55 - protein, 107 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIK

SEQ ID NO: 56 - protein, 11 aa, synthetic construct
RASQSISSWLA

SEQ ID NO: 57 - protein, 7 aa, synthetic construct
EASSLES

SEQ ID NO: 58 - protein, 9 aa, synthetic construct
QQSDSHPIT

SEQ ID NO: 59 - protein, 245 aa, synthetic construct
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIK

SEQ ID NO: 60 - protein, 245 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKGGGGSGGGGSGGGGSGGGGSQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSS

SEQ ID NO: 61 - protein, 118 aa, synthetic construct; identical to SEQ ID NO: 41

SEQ ID NO: 62 - protein, 5 aa, synthetic construct
DYYMS

SEQ ID NO: 63 - protein, 17 aa, synthetic construct
YISSSGSTIYYADSVKG

SEQ ID NO: 64 - protein, 9 aa, synthetic construct
DQGNYGVDV

SEQ ID NO: 65 - protein, 107 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIK

SEQ ID NO: 66 - protein, 11 aa, synthetic construct
RASQSISSWLA

SEQ ID NO: 67 - protein, 7 aa, synthetic construct
EASSLES

SEQ ID NO: 68 - protein, 9 aa, synthetic construct
QQANSHPIT

SEQ ID NO: 69 - protein, 245 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIK

SEQ ID NO: 70 - protein, 245 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSS

SEQ ID NO: 71 - protein, 122 aa, synthetic construct
EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSS

SEQ ID NO: 72 - protein, 5 aa, synthetic construct
NYAMS

SEQ ID NO: 73 - protein, 17 aa, synthetic construct
AISGSGGSTYYADSVKG

SEQ ID NO: 74 - protein, 13 aa, synthetic construct
PGDGYYEGVYFDY

SEQ ID NO: 75 - protein, 107 aa, synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIK

SEQ ID NO: 76 - protein, 11 aa, synthetic construct
RASQSISSYLN

SEQ ID NO: 77 - protein, 7 aa, synthetic construct
AASSLQS

SEQ ID NO: 78 - protein, 9 aa, synthetic construct
QQAHSSPIT

SEQ ID NO: 79 - protein, 249 aa, synthetic construct
EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIK

SEQ ID NO: 80 - protein, 249 aa, synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKGGGGSGGGGSGGGGSGGGGSEVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSS

SEQ ID NO: 81 - protein, 124 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSS

SEQ ID NO: 82 - protein, 7 aa, synthetic construct
TSGVGVG

SEQ ID NO: 83 - protein, 16 aa, synthetic construct
LIYWNDEKRYSPSLKS

SEQ ID NO: 84 - protein, 14 aa, synthetic construct
EGSHDYKSSNWFDP

SEQ ID NO: 85 - protein, 107 aa, synthetic construct
DIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIK

SEQ ID NO: 86 - protein, 11 aa, synthetic construct
QASQDIANYLN

SEQ ID NO: 87 - protein, 7 aa, synthetic construct
DASNLET

SEQ ID NO: 88 - protein, 10 aa, synthetic construct
QQHFNLPLTF

SEQ ID NO: 89 - protein, 251 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSGGGGSGGGGSGGGGSGGGGSDIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIK

SEQ ID NO: 90 - protein, 251 aa, synthetic construct
DIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSS

SEQ ID NO: 91 - protein, 124 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSS

SEQ ID NO: 92 - protein, 5 aa, synthetic construct
SYSMN

SEQ ID NO: 93 - protein, 17 aa, synthetic construct
SISSSSSYIYYADSVKG

SEQ ID NO: 94 - protein, 15 aa, synthetic construct
AGDTYSAADYYYMDV

SEQ ID NO: 95 - protein, 111 aa, synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIK

SEQ ID NO: 96 - protein, 16 aa, synthetic construct
RSSQSLLHSNGYNYLD

SEQ ID NO: 97 - protein, 7 aa, synthetic construct
LGSNRAS

SEQ ID NO: 98 - protein, 8 aa, synthetic construct
MQALGLIT

SEQ ID NO: 99 - protein, 255 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIK

SEQ ID NO: 100 - protein, 255 aa, synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKGGGGSGGGGSGGGGSGGGGSEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSS

SEQ ID NO: 101 - protein, 116 aa, synthetic construct
EVQLLESGGGLVQPGGSLRLSCAASGFTFGSEAMSWVRQAPGKERELVSAISGSGEVTYYADSVKGRFTISRDNSKNTLYLQMNSLRAEDTAVYYCQRLVEAKRHWGQGTQVTVSS

SEQ ID NO: 102 - protein, 5 aa, synthetic construct
SEAMS

SEQ ID NO: 103 - protein, 17 aa, synthetic construct
AISGSGEVTYYADSVKG

SEQ ID NO: 104 - protein, 7 aa, synthetic construct
LVEAKRH

SEQ ID NO: 105 - protein, 116 aa, synthetic construct
EVQLLESGGGLVQPGGSLRLSCAASGFTFESEAMSWYRQAPGKERELVSVITSEGSTYYADSVKGRFTISRDNSKNTLYLQMNSLRAEDTAVYYCAHIEWETRLNWGQGTQVTVSS

SEQ ID NO: 106 - protein, 5 aa, synthetic construct
SEAMS

SEQ ID NO: 107 - protein, 16 aa, synthetic construct
VITSEGSTYYADSVKG

SEQ ID NO: 108 - protein, 8 aa, synthetic construct
IEWETRLN

SEQ ID NO: 109 - protein, 118 aa, synthetic construct
EVQLLESGGGLVQPGGSLRLSCAASGFTFDEYTMHWFRQAPGKEREFVSAISGGGSETYYADSVKGRFTISRDNSKNTLYLQMNSLRAEDTAVYYCAAGGEEAGVGYWGQGTQVTVSS

SEQ ID NO: 110 - protein, 5 aa, synthetic construct
EYTMH

SEQ ID NO: 111 - protein, 17 aa, synthetic construct
AISGGGSETYYADSVKG

SEQ ID NO: 112 - protein, 9 aa, synthetic construct
GGEEAGVGY

SEQ ID NO: 113 - protein, 120 aa, synthetic construct
EVQLLESGGGLVQPGGSLRLSCAASGFTFEDYAMSWFRQAPGKEREGVSAISGKGGSTYYADSVKGRFTISRDNSKNTLYLQMNSLRAEDTAVYYCAVLDEEAGAEGGYWGQGTQVTVSS

SEQ ID NO: 114 - protein, 5 aa, synthetic construct
DYAMS

SEQ ID NO: 115 - protein, 17 aa, synthetic construct
AISGKGGSTYYADSVKG

SEQ ID NO: 116 - protein, 11 aa, synthetic construct
LDEEAGAEGGY

SEQ ID NO: 117 - protein, 120 aa, synthetic construct
EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSS

SEQ ID NO: 118 - protein, 5 aa, synthetic construct
RYAMS

SEQ ID NO: 119 - protein, 17 aa, synthetic construct
AISTSGDSTYYADSVKG

SEQ ID NO: 120 - protein, 11 aa, synthetic construct
LDEEAGAEGGY

SEQ ID NO: 121 - protein, 121 aa, synthetic construct
EVQLLESGGGLVQPGGSLRLSCAASGFTFASDAMSWYRQAPGKERELVSAISGSGGSTYYADSVKGRFTISRDNSKNTLYLQMNSLRAEDTAVYYCAAHDSGEAYLAFDYWGQGTQVTVSS

SEQ ID NO: 122 - protein, 5 aa, synthetic construct
SDAMS

SEQ ID NO: 123 - protein, 17 aa, synthetic construct
AISGSGGSTYYADSVKG

SEQ ID NO: 124 - protein, 12 aa, synthetic construct
HDSGEAYLAFDY

SEQ ID NO: 125 - protein, 121 aa, synthetic construct
EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSS

SEQ ID NO: 126 - protein, 5 aa, synthetic construct
SYTMS

SEQ ID NO: 127 - protein, 17 aa, synthetic construct
AISGHGDSTYYADSVKG

SEQ ID NO: 128 - protein, 12 aa, synthetic construct
ISITTEWLAGDY

SEQ ID NO: 129 - protein, 123 aa, synthetic construct
EVQLLESGGGLVQPGGSLRLSCAASGFTFSSYAMSWFRQAPGKEREFVSFISGSGDSTYYADSVKGRFTISRDNSKNTLYLQMNSLRAEDTAVYYCTRWPYDFEEPSEPGVYWGQGTQVTVSS

SEQ ID NO: 130 - protein, 5 aa, synthetic construct
SYAMS

SEQ ID NO: 131 - protein, 17 aa, synthetic construct
FISGSGDSTYYADSVKG

SEQ ID NO: 132 - protein, 14 aa, synthetic construct
WPYDFEEPSEPGVY

SEQ ID NO: 133 - protein, 123 aa, synthetic construct
EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSS

SEQ ID NO: 134 - protein, 5 aa, synthetic construct
DYDMS

SEQ ID NO: 135 - protein, 16 aa, synthetic construct
VIHSGGSTYYADSVKG

SEQ ID NO: 136 - protein, 15 aa, synthetic construct
GYYSDLSFDYYNFDY

SEQ ID NO: 137 - protein, 123 aa, synthetic construct
EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSS

SEQ ID NO: 138 - protein, 5 aa, synthetic construct
DYAMH

SEQ ID NO: 139 - protein, 16 aa, synthetic construct
SIDSGGSTYYADSVKG

SEQ ID NO: 140 - protein, 15 aa, synthetic construct
GFKGDHPHPKDAFDI

SEQ ID NO: 141 - protein, 125 aa, synthetic construct
EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSS

SEQ ID NO: 142 - protein, 5 aa, synthetic construct
SEGMS

SEQ ID NO: 143 - protein, 17 aa, synthetic construct
AISGSGDHTYYADSVRG

SEQ ID NO: 144 - protein, 16 aa, synthetic construct
LEGGPTTAIQPGGPDY

SEQ ID NO: 145 - protein, 45 aa, synthetic construct
TTTPAPRPPTPAPTIASQPLSLRPEACRPAAGGAVHTRGLDFACD

SEQ ID NO: 146 - protein, 39 aa, synthetic construct
IEVMYPPPYLDNEKSNGTIIHVKGKHLCPSPLFPGPSKP

SEQ ID NO: 147 - protein, 22 aa, synthetic construct
SGQVLLESNIKVLPTWSTPVQP

SEQ ID NO: 148 - protein, 12 aa, synthetic construct
ESKYGPPCPPCP

SEQ ID NO: 149 - protein, 228 aa, synthetic construct
ESKYGPPCPPCPAPPVAGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 150 - protein, 16 aa, synthetic construct
LEPKSCDKTHTCPPCP

SEQ ID NO: 151 - protein, 24 aa, synthetic construct
IYIWAPLAGTCGVLLLSLVITLYC

SEQ ID NO: 152 - protein, 27 aa, synthetic construct
IISFFLALTSTALLFLLFFLTLRFSVV

SEQ ID NO: 153 - protein, 27 aa, synthetic construct
FWVLVVVGGVLACYSLLVTVAFIIFWV

SEQ ID NO: 154 - protein, 21 aa, synthetic construct
VAAILGLGLVLGLLGPLAILL

SEQ ID NO: 155 - protein, 23 aa, synthetic construct
WLPIGCAAFVVVCILGCILICWL

SEQ ID NO: 156 - protein, 26 aa, synthetic construct
VMSVATIVIVDICITGGLLLLVYYWS

SEQ ID NO: 157 - protein, 22 aa, synthetic construct
MALIVLGGVAGLLLFIGLGIFF

SEQ ID NO: 158 - protein, 112 aa, synthetic construct
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 159 - protein, 42 aa, synthetic construct
KRGRKKLLYIFKQPFMRPVQTTQEEDGCSCRFPEEEEGGCEL

SEQ ID NO: 160 - protein, 41 aa, synthetic construct
RSKRSRLLHSDYMNMTPRRPGPTRKHYQPYAPPRDFAAYRS

SEQ ID NO: 161 - protein, 42 aa, synthetic construct
ALYLLRRDQRLPPDAHKPPGGGSFRTPIQEEQADAHSTLAKI

SEQ ID NO: 162 - protein, 35 aa, synthetic construct
TKKKYSSSVHDPNGEYMFMRAVNTAKKSRLTDVTL

SEQ ID NO: 163 - protein, 48 aa, synthetic construct
QRRKYRSNKGESPVEPAEPCHYSCPREEEGSTIPIQEDYRKPEPACSP

SEQ ID NO: 164 - protein, 174 aa, synthetic construct
KKKPLCLQREAKVPHLPADKARGTQGPEQQHLLITAPSSSSSSLESSASALDRRAPTRNQPQAPGVEASGAGEARASTGSSDSSPGGHGTQVNVTCIVNVCSSSDHSSQCSSQASSTMGDTDSSPSESPKDEQVPFSKEECAFRSQLETPETLLGSTEEKPLPLGVPDAGMKPS

SEQ ID NO: 165 - protein, 468 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 166 - protein, 467 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 167 - protein, 461 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 168 - protein, 471 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 169 - protein, 470 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 170 - protein, 464 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 171 - protein, 462 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 172 - protein, 461 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 173 - protein, 455 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 174 - protein, 465 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 175 - protein, 464 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 176 - protein, 458 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 177 - protein, 435 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 178 - protein, 434 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 179 - protein, 428 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 180 - protein, 438 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 181 - protein, 437 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKESKYGPPCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 182 - protein, 431 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKESKYGPPCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 183 - protein, 439 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 184 - protein, 438 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKLEPKSCDKTHTCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 185 - protein, 432 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKLEPKSCDKTHTCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 186 - protein, 442 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKLEPKSCDKTHTCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 187 - protein, 441 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKLEPKSCDKTHTCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 188 - protein, 435 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKLEPKSCDKTHTCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 189 - protein, 468 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 190 - protein, 467 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 191 - protein, 461 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 192 - protein, 471 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 193 - protein, 470 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 194 - protein, 464 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 195 - protein, 462 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 196 - protein, 461 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 197 - protein, 455 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 198 - protein, 465 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 199 - protein, 464 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 200 - protein, 458 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 201 - protein, 435 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 202 - protein, 434 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 203 - protein, 428 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 204 - protein, 438 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 205 - protein, 437 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSESKYGPPCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 206 - protein, 431 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSESKYGPPCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 207 - protein, 439 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 208 - protein, 438 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSLEPKSCDKTHTCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 209 - protein, 432 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSLEPKSCDKTHTCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 210 - protein, 442 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSLEPKSCDKTHTCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 211 - protein, 441 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSLEPKSCDKTHTCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 212 - protein, 435 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRVVYPITFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCARDEYGGFDIWGQGTMVTVSSLEPKSCDKTHTCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 213 - protein, 468 aa, synthetic construct
QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 214 - protein, 467 aa, synthetic construct
QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 215 - protein, 461 aa, synthetic construct
QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 216 - protein, 471 aa, synthetic construct
QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 217 - protein, 470 aa, synthetic construct
QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 218 - protein, 464 aa, synthetic construct
QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 219 - protein, 462 aa, synthetic construct
QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 220 - protein, 461 aa, synthetic construct
QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 221 - protein, 455 aa, synthetic construct
QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 222 - protein, 465 aa, synthetic construct
QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 223 - protein, 464 aa, synthetic construct
QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 224 - protein, 458 aa, synthetic construct
QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 225 - protein, 435 aa, synthetic construct
QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 226 - protein, 434 aa, synthetic construct
QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 227 - protein, 428 aa, synthetic construct
QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 228 - protein, 438 aa, synthetic construct
QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 229 - protein, 437 aa, synthetic construct
QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKESKYGPPCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 230 - protein, 431 aa, synthetic construct
QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKESKYGPPCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 231 - protein, 439 aa, synthetic construct
QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 232 - protein, 438 aa, synthetic construct
QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKLEPKSCDKTHTCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 233 - protein, 432 aa, synthetic construct
QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKLEPKSCDKTHTCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 234 - protein, 442 aa, synthetic construct
QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKLEPKSCDKTHTCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 235 - protein, 441 aa, synthetic construct
QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKLEPKSCDKTHTCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 236 - protein, 435 aa, synthetic construct
QITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKLEPKSCDKTHTCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 237 - protein, 468 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKGGGGSGGGGSGGGGSGGGGSQITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 238 - protein, 467 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKGGGGSGGGGSGGGGSGGGGSQITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 239 - protein, 461 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKGGGGSGGGGSGGGGSGGGGSQITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 240 - protein, 471 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKGGGGSGGGGSGGGGSGGGGSQITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 241 - protein, 470 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKGGGGSGGGGSGGGGSGGGGSQITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 242 - protein, 464 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKGGGGSGGGGSGGGGSGGGGSQITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 243 - protein, 462 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKGGGGSGGGGSGGGGSGGGGSQITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 244 - protein, 461 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKGGGGSGGGGSGGGGSGGGGSQITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 245 - protein, 455 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKGGGGSGGGGSGGGGSGGGGSQITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 246 - protein, 465 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKGGGGSGGGGSGGGGSGGGGSQITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 247 - protein, 464 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKGGGGSGGGGSGGGGSGGGGSQITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 248 - protein, 458 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKGGGGSGGGGSGGGGSGGGGSQITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 249 - protein, 435 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKGGGGSGGGGSGGGGSGGGGSQITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 250 - protein, 434 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKGGGGSGGGGSGGGGSGGGGSQITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 251 - protein, 428 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKGGGGSGGGGSGGGGSGGGGSQITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 252 - protein, 438 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKGGGGSGGGGSGGGGSGGGGSQITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 253 - protein, 437 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKGGGGSGGGGSGGGGSGGGGSQITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSESKYGPPCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 254 - protein, 431 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKGGGGSGGGGSGGGGSGGGGSQITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSESKYGPPCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 255 - protein, 439 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKGGGGSGGGGSGGGGSGGGGSQITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 256 - protein, 438 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKGGGGSGGGGSGGGGSGGGGSQITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSLEPKSCDKTHTCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 257 - protein, 432 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKGGGGSGGGGSGGGGSGGGGSQITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSLEPKSCDKTHTCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 258 - protein, 442 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKGGGGSGGGGSGGGGSGGGGSQITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSLEPKSCDKTHTCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 259 - protein, 441 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKGGGGSGGGGSGGGGSGGGGSQITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSLEPKSCDKTHTCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 260 - protein, 435 aa, synthetic construct
EIVLTQSPATLSLSPGERATLSCRASQSVSSYLAWYQQKPGQAPRLLIYDASNRATGIPARFSGSGSGTDFTLTISSLEPEDFAVYYCQQRFDYPITFGGGTKVEIKGGGGSGGGGSGGGGSGGGGSQITLKESGPTLVKPTQTLTLTCTFSGFSLSTSGVGVGWIRQPPGKALEWLALIYWNDDKRYSPSLKSRLTITKDTSKNQVVLTMTNMDPVDTAVYYCARDEYGGFDIWGQGTMVTVSSLEPKSCDKTHTCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 261 - protein, 466 aa, synthetic construct
QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSGGGGSGGGGSGGGGSGGGGSEIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 262 - protein, 465 aa, synthetic construct
QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSGGGGSGGGGSGGGGSGGGGSEIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 263 - protein, 459 aa, synthetic construct
QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSGGGGSGGGGSGGGGSGGGGSEIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 264 - protein, 469 aa, synthetic construct
QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSGGGGSGGGGSGGGGSGGGGSEIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 265 - protein, 468 aa, synthetic construct
QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSGGGGSGGGGSGGGGSGGGGSEIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 266 - protein, 462 aa, synthetic construct
QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSGGGGSGGGGSGGGGSGGGGSEIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 267 - protein, 460 aa, synthetic construct
QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSGGGGSGGGGSGGGGSGGGGSEIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 268 - protein, 459 aa, synthetic construct
QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSGGGGSGGGGSGGGGSGGGGSEIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 269 - protein, 453 aa, synthetic construct
QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSGGGGSGGGGSGGGGSGGGGSEIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 270 - protein, 463 aa, synthetic construct
QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSGGGGSGGGGSGGGGSGGGGSEIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 271 - protein, 462 aa, synthetic construct
QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSGGGGSGGGGSGGGGSGGGGSEIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 272 - protein, 456 aa, synthetic construct
QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSGGGGSGGGGSGGGGSGGGGSEIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 273 - protein, 433 aa, synthetic construct
QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSGGGGSGGGGSGGGGSGGGGSEIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 274 - protein, 432 aa, synthetic construct
QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSGGGGSGGGGSGGGGSGGGGSEIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 275 - protein, 426 aa, synthetic construct
QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSGGGGSGGGGSGGGGSGGGGSEIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 276 - protein, 436 aa, synthetic construct
QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSGGGGSGGGGSGGGGSGGGGSEIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 277 - protein, 435 aa, synthetic construct
QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSGGGGSGGGGSGGGGSGGGGSEIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKESKYGPPCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 278 - protein, 429 aa, synthetic construct
QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSGGGGSGGGGSGGGGSGGGGSEIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKESKYGPPCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 279 - protein, 437 aa, synthetic construct
QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSGGGGSGGGGSGGGGSGGGGSEIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 280 - protein, 436 aa, synthetic construct
QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSGGGGSGGGGSGGGGSGGGGSEIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKLEPKSCDKTHTCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 281 - protein, 430 aa, synthetic construct
QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSGGGGSGGGGSGGGGSGGGGSEIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKLEPKSCDKTHTCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 282 - protein, 440 aa, synthetic construct
QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSGGGGSGGGGSGGGGSGGGGSEIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKLEPKSCDKTHTCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 283 - protein, 439 aa, synthetic construct
QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSGGGGSGGGGSGGGGSGGGGSEIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKLEPKSCDKTHTCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 284 - protein, 433 aa, synthetic construct
QVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSGGGGSGGGGSGGGGSGGGGSEIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKLEPKSCDKTHTCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 285 - protein, 466 aa, synthetic construct
EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 286 - protein, 465 aa, synthetic construct
EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 287 - protein, 459 aa, synthetic construct
EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 288 - protein, 469 aa, synthetic construct
EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 289 - protein, 468 aa, synthetic construct
EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 290 - protein, 462 aa, synthetic construct
EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 291 - protein, 460 aa, synthetic construct
EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 292 - protein, 459 aa, synthetic construct
EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 293 - protein, 453 aa, synthetic construct
EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 294 - protein, 463 aa, synthetic construct
EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 295 - protein, 462 aa, synthetic construct
EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 296 - protein, 456 aa, synthetic construct
EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 297 - protein, 433 aa, synthetic construct
EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 298 - protein, 432 aa, synthetic construct
EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 299 - protein, 426 aa, synthetic construct
EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 300 - protein, 436 aa, synthetic construct
EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 301 - protein, 435 aa, synthetic construct
EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSESKYGPPCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 302 - protein, 429 aa, synthetic construct
EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSESKYGPPCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 303 - protein, 437 aa, synthetic construct
EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 304 - protein, 436 aa, synthetic construct
EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSLEPKSCDKTHTCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 305 - protein, 430 aa, synthetic construct
EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSLEPKSCDKTHTCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 306 - protein, 440 aa, synthetic construct
EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSLEPKSCDKTHTCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 307 - protein, 439 aa, synthetic construct
EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSLEPKSCDKTHTCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 308 - protein, 433 aa, synthetic construct
EIVLTQSPATLSLSPGERATLSCRASQSVSSYLAWFQQKPGQAPRLLIYDASNRATGIPARFSGSGSGTDFTLTISSLEPEDFAVYYCQQRVDLWTFGGGTKVEIKGGGGSGGGGSGGGGSGGGGSQVQLVESGGGVVQPGRSLRLSCAASGFTFSSYGMHWVRQAPGKGLEWVAVISYEGSNKYYADSVKGRFTISRDNSKNTLYLQMNSLRAEDTAVYYCARELGDGMDVWGQGTTVTVSSLEPKSCDKTHTCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 309 - protein, 468 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 310 - protein, 467 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 311 - protein, 461 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 312 - protein, 471 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 313 - protein, 470 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 314 - protein, 464 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 315 - protein, 462 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 316 - protein, 461 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 317 - protein, 455 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 318 - protein, 465 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 319 - protein, 464 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 320 - protein, 458 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 321 - protein, 435 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 322 - protein, 434 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 323 - protein, 428 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 324 - protein, 438 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 325 - protein, 437 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKESKYGPPCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 326 - protein, 431 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKESKYGPPCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 327 - protein, 439 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 328 - protein, 438 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKLEPKSCDKTHTCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 329 - protein, 432 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKLEPKSCDKTHTCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 330 - protein, 442 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKLEPKSCDKTHTCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 331 - protein, 441 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKLEPKSCDKTHTCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 332 - protein, 435 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKLEPKSCDKTHTCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 333 - protein, 468 aa, synthetic construct
DIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 334 - protein, 467 aa, synthetic construct
DIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 335 - protein, 461 aa, synthetic construct
DIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 336 - protein, 471 aa, synthetic construct
DIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 337 - protein, 470 aa, synthetic construct
DIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 338 - protein, 464 aa, synthetic construct
DIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 339 - protein, 462 aa, synthetic construct
DIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 340 - protein, 461 aa, synthetic construct
DIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 341 - protein, 455 aa, synthetic construct
DIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 342 - protein, 465 aa, synthetic construct
DIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 343 - protein, 464 aa, synthetic construct
DIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 344 - protein, 458 aa, synthetic construct
DIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 345 - protein, 435 aa, synthetic construct
DIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 346 - protein, 434 aa, synthetic construct
DIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 347 - protein, 428 aa, synthetic construct
DIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 348 - protein, 438 aa, synthetic construct
DIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 349 - protein, 437 aa, synthetic construct
DIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSESKYGPPCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 350 - protein, 431 aa, synthetic construct
DIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSESKYGPPCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 351 - protein, 439 aa, synthetic construct
DIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 352 - protein, 438 aa, synthetic construct
DIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSLEPKSCDKTHTCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 353 - protein, 432 aa, synthetic construct
DIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSLEPKSCDKTHTCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 354 - protein, 442 aa, synthetic construct
DIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSLEPKSCDKTHTCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 355 - protein, 441 aa, synthetic construct
DIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSLEPKSCDKTHTCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 356 - protein, 435 aa, synthetic construct
DIQMTQSPSTLSASVGDRVTITCRASQSISSWLAWYQQKPGKAPKLLIYDASSLESGVPSRFSGSGSGTEFTLTISSLQPDDFATYYCQQVSSLPPTFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSLEPKSCDKTHTCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 357 - protein, 468 aa, synthetic construct
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 358 - protein, 467 aa, synthetic construct
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 359 - protein, 461 aa, synthetic construct
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 360 - protein, 471 aa, synthetic construct
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 361 - protein, 470 aa, synthetic construct
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 362 - protein, 464 aa, synthetic construct
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 363 - protein, 462 aa, synthetic construct
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 364 - protein, 461 aa, synthetic construct
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 365 - protein, 455 aa, synthetic construct
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 366 - protein, 465 aa, synthetic construct
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 367 - protein, 464 aa, synthetic construct
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 368 - protein, 458 aa, synthetic construct
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 369 - protein, 435 aa, synthetic construct
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 370 - protein, 434 aa, synthetic construct
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 371 - protein, 428 aa, synthetic construct
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 372 - protein, 438 aa, synthetic construct
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 373 - protein, 437 aa, synthetic construct
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKESKYGPPCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 374 - protein, 431 aa, synthetic construct
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKESKYGPPCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 375 - protein, 439 aa, synthetic construct
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 376 - protein, 438 aa, synthetic construct
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKLEPKSCDKTHTCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 377 - protein, 432 aa, synthetic construct
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKLEPKSCDKTHTCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 378 - protein, 442 aa, synthetic construct
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKLEPKSCDKTHTCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 379 - protein, 441 aa, synthetic construct
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKLEPKSCDKTHTCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 380 - protein, 435 aa, synthetic construct
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKLEPKSCDKTHTCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 381 - protein, 468 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKGGGGSGGGGSGGGGSGGGGSQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 382 - protein, 467 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKGGGGSGGGGSGGGGSGGGGSQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 383 - protein, 461 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKGGGGSGGGGSGGGGSGGGGSQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 384 - protein, 471 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKGGGGSGGGGSGGGGSGGGGSQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 385 - protein, 470 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKGGGGSGGGGSGGGGSGGGGSQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 386 - protein, 464 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKGGGGSGGGGSGGGGSGGGGSQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 387 - protein, 462 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKGGGGSGGGGSGGGGSGGGGSQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 388 - protein, 461 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKGGGGSGGGGSGGGGSGGGGSQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 389 - protein, 455 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKGGGGSGGGGSGGGGSGGGGSQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 390 - protein, 465 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKGGGGSGGGGSGGGGSGGGGSQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 391 - protein, 464 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKGGGGSGGGGSGGGGSGGGGSQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 392 - protein, 458 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKGGGGSGGGGSGGGGSGGGGSQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 393 - protein, 435 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKGGGGSGGGGSGGGGSGGGGSQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 394 - protein, 434 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKGGGGSGGGGSGGGGSGGGGSQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 395 - protein, 428 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKGGGGSGGGGSGGGGSGGGGSQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 396 - protein, 438 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKGGGGSGGGGSGGGGSGGGGSQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 397 - protein, 437 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKGGGGSGGGGSGGGGSGGGGSQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSESKYGPPCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 398 - protein, 431 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKGGGGSGGGGSGGGGSGGGGSQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSESKYGPPCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 399 - protein, 439 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKGGGGSGGGGSGGGGSGGGGSQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 400 - protein, 438 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKGGGGSGGGGSGGGGSGGGGSQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSLEPKSCDKTHTCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 401 - protein, 432 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKGGGGSGGGGSGGGGSGGGGSQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSLEPKSCDKTHTCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 402 - protein, 442 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKGGGGSGGGGSGGGGSGGGGSQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSLEPKSCDKTHTCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 403 - protein, 441 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKGGGGSGGGGSGGGGSGGGGSQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSLEPKSCDKTHTCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 404 - protein, 435 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQSDSHPITFGGGTKVEIKGGGGSGGGGSGGGGSGGGGSQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSLEPKSCDKTHTCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 405 - protein, 468 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 406 - protein, 467 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 407 - protein, 461 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 408 - protein, 471 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 409 - protein, 470 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 410 - protein, 464 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 411 - protein, 462 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 412 - protein, 461 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 413 - protein, 455 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 414 - protein, 465 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 415 - protein, 464 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 416 - protein, 458 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 417 - protein, 435 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 418 - protein, 434 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 419 - protein, 428 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 420 - protein, 438 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 421 - protein, 437 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKESKYGPPCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 422 - protein, 431 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKESKYGPPCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 423 - protein, 439 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 424 - protein, 438 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKLEPKSCDKTHTCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 425 - protein, 432 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKLEPKSCDKTHTCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 426 - protein, 442 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKLEPKSCDKTHTCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 427 - protein, 441 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKLEPKSCDKTHTCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 428 - protein, 435 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSGGGGSGGGGSGGGGSGGGGSDIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKLEPKSCDKTHTCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 429 - protein, 468 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 430 - protein, 467 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 431 - protein, 461 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 432 - protein, 471 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 433 - protein, 470 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 434 - protein, 464 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 435 - protein, 462 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 436 - protein, 461 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 437 - protein, 455 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 438 - protein, 465 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 439 - protein, 464 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 440 - protein, 458 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 441 - protein, 435 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 442 - protein, 434 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 443 - protein, 428 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 444 - protein, 438 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 445 - protein, 437 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSESKYGPPCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 446 - protein, 431 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSESKYGPPCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 447 - protein, 439 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 448 - protein, 438 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSLEPKSCDKTHTCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 449 - protein, 432 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSLEPKSCDKTHTCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 450 - protein, 442 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSLEPKSCDKTHTCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 451 - protein, 441 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSLEPKSCDKTHTCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 452 - protein, 435 aa, synthetic construct
DIQMTQSPSTLSASVGDRVTITCRASQSISSWLAWYQQKPGKAPKLLIYEASSLESGVPSRFSGSGSGTEFTLTISSLQPDDFATYYCQQANSHPITFGGGTKVEIKGGGGSGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDQGNYGVDVWGQGTTVTVSSLEPKSCDKTHTCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 453 - protein, 472 aa, synthetic construct
EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 454 - protein, 471 aa, synthetic construct
EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 455 - protein, 465 aa, synthetic construct
EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 456 - protein, 475 aa, synthetic construct
EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 457 - protein, 474 aa, synthetic construct
EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 458 - protein, 468 aa, synthetic construct
EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 459 - protein, 466 aa, synthetic construct
EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 460 - protein, 465 aa, synthetic construct
EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 461 - protein, 459 aa, synthetic construct
EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 462 - protein, 469 aa, synthetic construct
EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 463 - protein, 468 aa, synthetic construct
EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 464 - protein, 462 aa, synthetic construct
EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 465 - protein, 439 aa, synthetic construct
EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 466 - protein, 438 aa, synthetic construct
EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 467 - protein, 432 aa, synthetic construct
EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 468 - protein, 442 aa, synthetic construct
EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 469 - protein, 441 aa, synthetic construct
EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKESKYGPPCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 470 - protein, 435 aa, synthetic construct
EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKESKYGPPCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 471 - protein, 443 aa, synthetic construct
EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 472 - protein, 442 aa, synthetic construct
EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKLEPKSCDKTHTCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 473 - protein, 436 aa, synthetic construct
EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKLEPKSCDKTHTCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 474 - protein, 446 aa, synthetic construct
EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKLEPKSCDKTHTCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 475 - protein, 445 aa, synthetic construct
EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKLEPKSCDKTHTCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 476 - protein, 439 aa, synthetic construct
EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSGGGGSGGGGSGGGGSGGGGSDIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKLEPKSCDKTHTCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 477 - protein, 472 aa, synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKGGGGSGGGGSGGGGSGGGGSEVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 478 - protein, 471 aa, synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKGGGGSGGGGSGGGGSGGGGSEVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 479 - protein, 465 aa, synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKGGGGSGGGGSGGGGSGGGGSEVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 480 - protein, 475 aa, synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKGGGGSGGGGSGGGGSGGGGSEVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 481 - protein, 474 aa, synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKGGGGSGGGGSGGGGSGGGGSEVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 482 - protein, 468 aa, synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKGGGGSGGGGSGGGGSGGGGSEVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 483 - protein, 466 aa, synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKGGGGSGGGGSGGGGSGGGGSEVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 484 - protein, 465 aa, synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKGGGGSGGGGSGGGGSGGGGSEVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 485 - protein, 459 aa, synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKGGGGSGGGGSGGGGSGGGGSEVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 486 - protein, 469 aa, synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKGGGGSGGGGSGGGGSGGGGSEVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 487 - protein, 468 aa, synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKGGGGSGGGGSGGGGSGGGGSEVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 488 - protein, 462 aa, synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKGGGGSGGGGSGGGGSGGGGSEVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 489 - protein, 439 aa, synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKGGGGSGGGGSGGGGSGGGGSEVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 490 - protein, 438 aa, synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKGGGGSGGGGSGGGGSGGGGSEVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 491 - protein, 432 aa, synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKGGGGSGGGGSGGGGSGGGGSEVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 492 - protein, 442 aa, synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKGGGGSGGGGSGGGGSGGGGSEVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 493 - protein, 441 aa, synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKGGGGSGGGGSGGGGSGGGGSEVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSESKYGPPCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 494 - protein, 435 aa, synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKGGGGSGGGGSGGGGSGGGGSEVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSESKYGPPCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 495 - protein, 443 aa, synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKGGGGSGGGGSGGGGSGGGGSEVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 496 - protein, 442 aa, synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKGGGGSGGGGSGGGGSGGGGSEVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSLEPKSCDKTHTCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 497 - protein, 436 aa, synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKGGGGSGGGGSGGGGSGGGGSEVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSLEPKSCDKTHTCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 498 - protein, 446 aa, synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKGGGGSGGGGSGGGGSGGGGSEVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSLEPKSCDKTHTCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 499 - protein, 445 aa, synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKGGGGSGGGGSGGGGSGGGGSEVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSLEPKSCDKTHTCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 500 - protein, 439 aa, synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQAHSSPITFGGGTKVEIKGGGGSGGGGSGGGGSGGGGSEVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCARPGDGYYEGVYFDYWGQGTLVTVSSLEPKSCDKTHTCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 501 - protein, 474 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSGGGGSGGGGSGGGGSGGGGSDIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 502 - protein, 473 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSGGGGSGGGGSGGGGSGGGGSDIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 503 - protein, 467 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSGGGGSGGGGSGGGGSGGGGSDIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 504 - protein, 477 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSGGGGSGGGGSGGGGSGGGGSDIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 505 - protein, 476 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSGGGGSGGGGSGGGGSGGGGSDIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 506 - protein, 470 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSGGGGSGGGGSGGGGSGGGGSDIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 507 - protein, 468 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSGGGGSGGGGSGGGGSGGGGSDIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 508 - protein, 467 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSGGGGSGGGGSGGGGSGGGGSDIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 509 - protein, 461 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSGGGGSGGGGSGGGGSGGGGSDIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 510 - protein, 471 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSGGGGSGGGGSGGGGSGGGGSDIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 511 - protein, 470 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSGGGGSGGGGSGGGGSGGGGSDIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 512 - protein, 464 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSGGGGSGGGGSGGGGSGGGGSDIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 513 - protein, 441 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSGGGGSGGGGSGGGGSGGGGSDIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 514 - protein, 440 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSGGGGSGGGGSGGGGSGGGGSDIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 515 - protein, 434 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSGGGGSGGGGSGGGGSGGGGSDIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 516 - protein, 444 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSGGGGSGGGGSGGGGSGGGGSDIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 517 - protein, 443 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSGGGGSGGGGSGGGGSGGGGSDIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKESKYGPPCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 518 - protein, 437 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSGGGGSGGGGSGGGGSGGGGSDIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKESKYGPPCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 519 - protein, 445 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSGGGGSGGGGSGGGGSGGGGSDIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 520 - protein, 444 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSGGGGSGGGGSGGGGSGGGGSDIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKLEPKSCDKTHTCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 521 - protein, 438 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSGGGGSGGGGSGGGGSGGGGSDIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKLEPKSCDKTHTCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 522 - protein, 448 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSGGGGSGGGGSGGGGSGGGGSDIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKLEPKSCDKTHTCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 523 - protein, 447 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSGGGGSGGGGSGGGGSGGGGSDIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKLEPKSCDKTHTCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 524 - protein, 441 aa, synthetic construct
QITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSGGGGSGGGGSGGGGSGGGGSDIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKLEPKSCDKTHTCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 525 - protein, 474 aa, synthetic construct
DIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 526 - protein, 473 aa, synthetic construct
DIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 527 - protein, 467 aa, synthetic construct
DIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 528 - protein, 477 aa, synthetic construct
DIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 529 - protein, 476 aa, synthetic construct
DIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 530 - protein, 470 aa, synthetic construct
DIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 531 - protein, 468 aa, synthetic construct
DIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 532 - protein, 467 aa, synthetic construct
DIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 533 - protein, 461 aa, synthetic construct
DIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 534 - protein, 471 aa, synthetic construct
DIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 535 - protein, 470 aa, synthetic construct
DIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 536 - protein, 464 aa, synthetic construct
DIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 537 - protein, 441 aa, synthetic construct
DIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 538 - protein, 440 aa, synthetic construct
DIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 539 - protein, 434 aa, synthetic construct
DIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 540 - protein, 444 aa, synthetic construct
DIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 541 - protein, 443 aa, synthetic construct
DIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSESKYGPPCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 542 - protein, 437 aa, synthetic construct
DIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSESKYGPPCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 543 - protein, 445 aa, synthetic construct
DIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 544 - protein, 444 aa, synthetic construct
DIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSLEPKSCDKTHTCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 545 - protein, 438 aa, synthetic construct
DIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSLEPKSCDKTHTCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 546 - protein, 448 aa, synthetic construct
DIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSLEPKSCDKTHTCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 547 - protein, 447 aa, synthetic construct
DIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSLEPKSCDKTHTCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 548 - protein, 441 aa, synthetic construct
DIQMTQSPSSLSASVGDRVTITCQASQDIANYLNWYQQKPGKAPKLLIYDASNLETGVPSRFSGSGSGTDFTFTISSLQPEDIATYYCQQHFNLPLTFGGGTKVEIKGGGGSGGGGSGGGGSGGGGSQITLKESGPTLVKPTQTLTLTCTFSGFSLSTSGVGVGWIRQPPGKALEWLALIYWNDEKRYSPSLKSRLTITKDTSKNQVVLTMTNMDPVDTAVYYCAREGSHDYKSSNWFDPWGQGTLVTVSSLEPKSCDKTHTCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 549 - protein, 478 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 550 - protein, 477 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 551 - protein, 471 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 552 - protein, 481 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 553 - protein, 480 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 554 - protein, 474 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 555 - protein, 472 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 556 - protein, 471 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 557 - protein, 465 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 558 - protein, 475 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 559 - protein, 474 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 560 - protein, 468 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 561 - protein, 445 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 562 - protein, 444 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 563 - protein, 438 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 564 - protein, 448 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 565 - protein, 447 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKESKYGPPCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 566 - protein, 441 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKESKYGPPCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 567 - protein, 449 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 568 - protein, 448 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKLEPKSCDKTHTCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 569 - protein, 442 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKLEPKSCDKTHTCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 570 - protein, 452 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKLEPKSCDKTHTCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 571 - protein, 451 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKLEPKSCDKTHTCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 572 - protein, 445 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSGGGGSGGGGSGGGGSGGGGSDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKLEPKSCDKTHTCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 573 - protein, 478 aa, synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKGGGGSGGGGSGGGGSGGGGSEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 574 - protein, 477 aa, synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKGGGGSGGGGSGGGGSGGGGSEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 575 - protein, 471 aa, synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKGGGGSGGGGSGGGGSGGGGSEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 576 - protein, 481 aa, synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKGGGGSGGGGSGGGGSGGGGSEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 577 - protein, 480 aa, synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKGGGGSGGGGSGGGGSGGGGSEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 578 - protein, 474 aa, synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKGGGGSGGGGSGGGGSGGGGSEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 579 - protein, 472 aa, synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKGGGGSGGGGSGGGGSGGGGSEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 580 - protein, 471 aa, synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKGGGGSGGGGSGGGGSGGGGSEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 581 - protein, 465 aa, synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKGGGGSGGGGSGGGGSGGGGSEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 582 - protein, 475 aa, synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKGGGGSGGGGSGGGGSGGGGSEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 583 - protein, 474 aa, synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKGGGGSGGGGSGGGGSGGGGSEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 584 - protein, 468 aa, synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKGGGGSGGGGSGGGGSGGGGSEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 585 - protein, 445 aa, synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKGGGGSGGGGSGGGGSGGGGSEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 586 - protein, 444 aa, synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKGGGGSGGGGSGGGGSGGGGSEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 587 - protein, 438 aa, synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKGGGGSGGGGSGGGGSGGGGSEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 588 - protein, 448 aa, synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKGGGGSGGGGSGGGGSGGGGSEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 589 - protein, 447 aa, synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKGGGGSGGGGSGGGGSGGGGSEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSESKYGPPCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 590 - protein, 441 aa, synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKGGGGSGGGGSGGGGSGGGGSEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSESKYGPPCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 591 - protein, 449 aa, synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKGGGGSGGGGSGGGGSGGGGSEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 592 - protein, 448 aa, synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKGGGGSGGGGSGGGGSGGGGSEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSLEPKSCDKTHTCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 593 - protein, 442 aa, synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKGGGGSGGGGSGGGGSGGGGSEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSLEPKSCDKTHTCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 594 - protein, 452 aa, synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKGGGGSGGGGSGGGGSGGGGSEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSLEPKSCDKTHTCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 595 - protein, 451 aa, synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKGGGGSGGGGSGGGGSGGGGSEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSLEPKSCDKTHTCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 596 - protein, 445 aa, synthetic construct
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALGLITFGGGTKVEIKGGGGSGGGGSGGGGSGGGGSEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAGDTYSAADYYYMDVWGKGTTVTVSSLEPKSCDKTHTCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 597 - protein, 339 aa, synthetic construct
EVQLLESGGGLVQPGGSLRLSCAASGFTFGSEAMSWVRQAPGKERELVSAISGSGEVTYYADSVKGRFTISRDNSKNTLYLQMNSLRAEDTAVYYCQRLVEAKRHWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 598 - protein, 338 aa, synthetic construct
EVQLLESGGGLVQPGGSLRLSCAASGFTFGSEAMSWVRQAPGKERELVSAISGSGEVTYYADSVKGRFTISRDNSKNTLYLQMNSLRAEDTAVYYCQRLVEAKRHWGQGTQVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 599 - protein, 332 aa, synthetic construct
EVQLLESGGGLVQPGGSLRLSCAASGFTFGSEAMSWVRQAPGKERELVSAISGSGEVTYYADSVKGRFTISRDNSKNTLYLQMNSLRAEDTAVYYCQRLVEAKRHWGQGTQVTVSSTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 600 - protein, 342 aa, synthetic construct
EVQLLESGGGLVQPGGSLRLSCAASGFTFGSEAMSWVRQAPGKERELVSAISGSGEVTYYADSVKGRFTISRDNSKNTLYLQMNSLRAEDTAVYYCQRLVEAKRHWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 601 - protein, 341 aa, synthetic construct
EVQLLESGGGLVQPGGSLRLSCAASGFTFGSEAMSWVRQAPGKERELVSAISGSGEVTYYADSVKGRFTISRDNSKNTLYLQMNSLRAEDTAVYYCQRLVEAKRHWGQGTQVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 602 - protein, 335 aa, synthetic construct
EVQLLESGGGLVQPGGSLRLSCAASGFTFGSEAMSWVRQAPGKERELVSAISGSGEVTYYADSVKGRFTISRDNSKNTLYLQMNSLRAEDTAVYYCQRLVEAKRHWGQGTQVTVSSTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 603 - protein, 333 aa, synthetic construct
EVQLLESGGGLVQPGGSLRLSCAASGFTFGSEAMSWVRQAPGKERELVSAISGSGEVTYYADSVKGRFTISRDNSKNTLYLQMNSLRAEDTAVYYCQRLVEAKRHWGQGTQVTVSSIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 604 - protein, 332 aa, synthetic construct
EVQLLESGGGLVQPGGSLRLSCAASGFTFGSEAMSWVRQAPGKERELVSAISGSGEVTYYADSVKGRFTISRDNSKNTLYLQMNSLRAEDTAVYYCQRLVEAKRHWGQGTQVTVSSIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 605 - protein, 326 aa, synthetic construct
EVQLLESGGGLVQPGGSLRLSCAASGFTFGSEAMSWVRQAPGKERELVSAISGSGEVTYYADSVKGRFTISRDNSKNTLYLQMNSLRAEDTAVYYCQRLVEAKRHWGQGTQVTVSSIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 606 - protein, 336 aa, synthetic construct
EVQLLESGGGLVQPGGSLRLSCAASGFTFGSEAMSWVRQAPGKERELVSAISGSGEVTYYADSVKGRFTISRDNSKNTLYLQMNSLRAEDTAVYYCQRLVEAKRHWGQGTQVTVSSIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 607 - protein, 335 aa, synthetic construct
EVQLLESGGGLVQPGGSLRLSCAASGFTFGSEAMSWVRQAPGKERELVSAISGSGEVTYYADSVKGRFTISRDNSKNTLYLQMNSLRAEDTAVYYCQRLVEAKRHWGQGTQVTVSSIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 608 - protein, 329 aa, synthetic construct
EVQLLESGGGLVQPGGSLRLSCAASGFTFGSEAMSWVRQAPGKERELVSAISGSGEVTYYADSVKGRFTISRDNSKNTLYLQMNSLRAEDTAVYYCQRLVEAKRHWGQGTQVTVSSIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 609 - protein, 306 aa, synthetic construct
EVQLLESGGGLVQPGGSLRLSCAASGFTFGSEAMSWVRQAPGKERELVSAISGSGEVTYYADSVKGRFTISRDNSKNTLYLQMNSLRAEDTAVYYCQRLVEAKRHWGQGTQVTVSSESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 610 - protein, 305 aa, synthetic construct
EVQLLESGGGLVQPGGSLRLSCAASGFTFGSEAMSWVRQAPGKERELVSAISGSGEVTYYADSVKGRFTISRDNSKNTLYLQMNSLRAEDTAVYYCQRLVEAKRHWGQGTQVTVSSESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 611 - protein, 299 aa, synthetic construct
EVQLLESGGGLVQPGGSLRLSCAASGFTFGSEAMSWVRQAPGKERELVSAISGSGEVTYYADSVKGRFTISRDNSKNTLYLQMNSLRAEDTAVYYCQRLVEAKRHWGQGTQVTVSSESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 612 - protein, 309 aa, synthetic construct
EVQLLESGGGLVQPGGSLRLSCAASGFTFGSEAMSWVRQAPGKERELVSAISGSGEVTYYADSVKGRFTISRDNSKNTLYLQMNSLRAEDTAVYYCQRLVEAKRHWGQGTQVTVSSESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 613 - protein, 308 aa, synthetic construct
EVQLLESGGGLVQPGGSLRLSCAASGFTFGSEAMSWVRQAPGKERELVSAISGSGEVTYYADSVKGRFTISRDNSKNTLYLQMNSLRAEDTAVYYCQRLVEAKRHWGQGTQVTVSSESKYGPPCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 614 - protein, 302 aa, synthetic construct
EVQLLESGGGLVQPGGSLRLSCAASGFTFGSEAMSWVRQAPGKERELVSAISGSGEVTYYADSVKGRFTISRDNSKNTLYLQMNSLRAEDTAVYYCQRLVEAKRHWGQGTQVTVSSESKYGPPCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 615 - protein, 310 aa, synthetic construct
EVQLLESGGGLVQPGGSLRLSCAASGFTFGSEAMSWVRQAPGKERELVSAISGSGEVTYYADSVKGRFTISRDNSKNTLYLQMNSLRAEDTAVYYCQRLVEAKRHWGQGTQVTVSSLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 616 - protein, 309 aa, synthetic construct
EVQLLESGGGLVQPGGSLRLSCAASGFTFGSEAMSWVRQAPGKERELVSAISGSGEVTYYADSVKGRFTISRDNSKNTLYLQMNSLRAEDTAVYYCQRLVEAKRHWGQGTQVTVSSLEPKSCDKTHTCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 617 - protein, 303 aa, synthetic construct
EVQLLESGGGLVQPGGSLRLSCAASGFTFGSEAMSWVRQAPGKERELVSAISGSGEVTYYADSVKGRFTISRDNSKNTLYLQMNSLRAEDTAVYYCQRLVEAKRHWGQGTQVTVSSLEPKSCDKTHTCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 618 - protein, 313 aa, synthetic construct
EVQLLESGGGLVQPGGSLRLSCAASGFTFGSEAMSWVRQAPGKERELVSAISGSGEVTYYADSVKGRFTISRDNSKNTLYLQMNSLRAEDTAVYYCQRLVEAKRHWGQGTQVTVSSLEPKSCDKTHTCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 619 - protein, 312 aa, synthetic construct
EVQLLESGGGLVQPGGSLRLSCAASGFTFGSEAMSWVRQAPGKERELVSAISGSGEVTYYADSVKGRFTISRDNSKNTLYLQMNSLRAEDTAVYYCQRLVEAKRHWGQGTQVTVSSLEPKSCDKTHTCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 620 - protein, 306 aa, synthetic construct
EVQLLESGGGLVQPGGSLRLSCAASGFTFGSEAMSWVRQAPGKERELVSAISGSGEVTYYADSVKGRFTISRDNSKNTLYLQMNSLRAEDTAVYYCQRLVEAKRHWGQGTQVTVSSLEPKSCDKTHTCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 621 - protein, 339 aa, synthetic construct
EVQLLESGGGLVQPGGSLRLSCAASGFTFESEAMSWYRQAPGKERELVSVITSEGSTYYADSVKGRFTISRDNSKNTLYLQMNSLRAEDTAVYYCAHIEWETRLNWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 622 - protein, 338 aa, synthetic construct
EVQLLESGGGLVQPGGSLRLSCAASGFTFESEAMSWYRQAPGKERELVSVITSEGSTYYADSVKGRFTISRDNSKNTLYLQMNSLRAEDTAVYYCAHIEWETRLNWGQGTQVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 623 - protein, 332 aa, synthetic construct
EVQLLESGGGLVQPGGSLRLSCAASGFTFESEAMSWYRQAPGKERELVSVITSEGSTYYADSVKGRFTISRDNSKNTLYLQMNSLRAEDTAVYYCAHIEWETRLNWGQGTQVTVSSTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 624 - protein, 342 aa, synthetic construct
EVQLLESGGGLVQPGGSLRLSCAASGFTFESEAMSWYRQAPGKERELVSVITSEGSTYYADSVKGRFTISRDNSKNTLYLQMNSLRAEDTAVYYCAHIEWETRLNWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 625 - protein, 341 aa, synthetic construct
EVQLLESGGGLVQPGGSLRLSCAASGFTFESEAMSWYRQAPGKERELVSVITSEGSTYYADSVKGRFTISRDNSKNTLYLQMNSLRAEDTAVYYCAHIEWETRLNWGQGTQVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 626 - protein, 335 aa, synthetic construct
EVQLLESGGGLVQPGGSLRLSCAASGFTFESEAMSWYRQAPGKERELVSVITSEGSTYYADSVKGRFTISRDNSKNTLYLQMNSLRAEDTAVYYCAHIEWETRLNWGQGTQVTVSSTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 627 - protein, 333 aa, synthetic construct
EVQLLESGGGLVQPGGSLRLSCAASGFTFESEAMSWYRQAPGKERELVSVITSEGSTYYADSVKGRFTISRDNSKNTLYLQMNSLRAEDTAVYYCAHIEWETRLNWGQGTQVTVSSIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 628 - protein, 332 aa, synthetic construct
EVQLLESGGGLVQPGGSLRLSCAASGFTFESEAMSWYRQAPGKERELVSVITSEGSTYYADSVKGRFTISRDNSKNTLYLQMNSLRAEDTAVYYCAHIEWETRLNWGQGTQVTVSSIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 629 - protein, 326 aa, synthetic construct
EVQLLESGGGLVQPGGSLRLSCAASGFTFESEAMSWYRQAPGKERELVSVITSEGSTYYADSVKGRFTISRDNSKNTLYLQMNSLRAEDTAVYYCAHIEWETRLNWGQGTQVTVSSIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 630 - protein, 336 aa, synthetic construct
EVQLLESGGGLVQPGGSLRLSCAASGFTFESEAMSWYRQAPGKERELVSVITSEGSTYYADSVKGRFTISRDNSKNTLYLQMNSLRAEDTAVYYCAHIEWETRLNWGQGTQVTVSSIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 631 - protein, 335 aa, synthetic construct
EVQLLESGGGLVQPGGSLRLSCAASGFTFESEAMSWYRQAPGKERELVSVITSEGSTYYADSVKGRFTISRDNSKNTLYLQMNSLRAEDTAVYYCAHIEWETRLNWGQGTQVTVSSIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 632 - protein, 329 aa, synthetic construct
EVQLLESGGGLVQPGGSLRLSCAASGFTFESEAMSWYRQAPGKERELVSVITSEGSTYYADSVKGRFTISRDNSKNTLYLQMNSLRAEDTAVYYCAHIEWETRLNWGQGTQVTVSSIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 633 - protein, 306 aa, synthetic construct
EVQLLESGGGLVQPGGSLRLSCAASGFTFESEAMSWYRQAPGKERELVSVITSEGSTYYADSVKGRFTISRDNSKNTLYLQMNSLRAEDTAVYYCAHIEWETRLNWGQGTQVTVSSESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 634 - protein, 305 aa, synthetic construct
EVQLLESGGGLVQPGGSLRLSCAASGFTFESEAMSWYRQAPGKERELVSVITSEGSTYYADSVKGRFTISRDNSKNTLYLQMNSLRAEDTAVYYCAHIEWETRLNWGQGTQVTVSSESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 635 - protein, 299 aa, synthetic construct
EVQLLESGGGLVQPGGSLRLSCAASGFTFESEAMSWYRQAPGKERELVSVITSEGSTYYADSVKGRFTISRDNSKNTLYLQMNSLRAEDTAVYYCAHIEWETRLNWGQGTQVTVSSESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 636 - protein, 309 aa, synthetic construct
EVQLLESGGGLVQPGGSLRLSCAASGFTFESEAMSWYRQAPGKERELVSVITSEGSTYYADSVKGRFTISRDNSKNTLYLQMNSLRAEDTAVYYCAHIEWETRLNWGQGTQVTVSSESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 637 - protein, 308 aa, synthetic construct
EVQLLESGGGLVQPGGSLRLSCAASGFTFESEAMSWYRQAPGKERELVSVITSEGSTYYADSVKGRFTISRDNSKNTLYLQMNSLRAEDTAVYYCAHIEWETRLNWGQGTQVTVSSESKYGPPCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 638 - protein, 302 aa, synthetic construct
EVQLLESGGGLVQPGGSLRLSCAASGFTFESEAMSWYRQAPGKERELVSVITSEGSTYYADSVKGRFTISRDNSKNTLYLQMNSLRAEDTAVYYCAHIEWETRLNWGQGTQVTVSSESKYGPPCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 639 - protein, 310 aa, synthetic construct
EVQLLESGGGLVQPGGSLRLSCAASGFTFESEAMSWYRQAPGKERELVSVITSEGSTYYADSVKGRFTISRDNSKNTLYLQMNSLRAEDTAVYYCAHIEWETRLNWGQGTQVTVSSLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 640 - protein, 309 aa, synthetic construct
EVQLLESGGGLVQPGGSLRLSCAASGFTFESEAMSWYRQAPGKERELVSVITSEGSTYYADSVKGRFTISRDNSKNTLYLQMNSLRAEDTAVYYCAHIEWETRLNWGQGTQVTVSSLEPKSCDKTHTCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 641 - protein, 303 aa, synthetic construct
EVQLLESGGGLVQPGGSLRLSCAASGFTFESEAMSWYRQAPGKERELVSVITSEGSTYYADSVKGRFTISRDNSKNTLYLQMNSLRAEDTAVYYCAHIEWETRLNWGQGTQVTVSSLEPKSCDKTHTCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 642 - protein, 313 aa, synthetic construct
EVQLLESGGGLVQPGGSLRLSCAASGFTFESEAMSWYRQAPGKERELVSVITSEGSTYYADSVKGRFTISRDNSKNTLYLQMNSLRAEDTAVYYCAHIEWETRLNWGQGTQVTVSSLEPKSCDKTHTCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 643 - protein, 312 aa, synthetic construct
EVQLLESGGGLVQPGGSLRLSCAASGFTFESEAMSWYRQAPGKERELVSVITSEGSTYYADSVKGRFTISRDNSKNTLYLQMNSLRAEDTAVYYCAHIEWETRLNWGQGTQVTVSSLEPKSCDKTHTCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 644 - protein, 306 aa, synthetic construct
EVQLLESGGGLVQPGGSLRLSCAASGFTFESEAMSWYRQAPGKERELVSVITSEGSTYYADSVKGRFTISRDNSKNTLYLQMNSLRAEDTAVYYCAHIEWETRLNWGQGTQVTVSSLEPKSCDKTHTCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 645 - protein, 341 aa, synthetic construct
EVQLLESGGGLVQPGGSLRLSCAASGFTFDEYTMHWFRQAPGKEREFVSAISGGGSETYYADSVKGRFTISRDNSKNTLYLQMNSLRAEDTAVYYCAAGGEEAGVGYWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 646 - protein, 340 aa, synthetic construct
EVQLLESGGGLVQPGGSLRLSCAASGFTFDEYTMHWFRQAPGKEREFVSAISGGGSETYYADSVKGRFTISRDNSKNTLYLQMNSLRAEDTAVYYCAAGGEEAGVGYWGQGTQVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 647 - protein, 334 aa, synthetic construct
EVQLLESGGGLVQPGGSLRLSCAASGFTFDEYTMHWFRQAPGKEREFVSAISGGGSETYYADSVKGRFTISRDNSKNTLYLQMNSLRAEDTAVYYCAAGGEEAGVGYWGQGTQVTVSSTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 648 - protein, 344 aa, synthetic construct
EVQLLESGGGLVQPGGSLRLSCAASGFTFDEYTMHWFRQAPGKEREFVSAISGGGSETYYADSVKGRFTISRDNSKNTLYLQMNSLRAEDTAVYYCAAGGEEAGVGYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 649 - protein, 343 aa, synthetic construct
EVQLLESGGGLVQPGGSLRLSCAASGFTFDEYTMHWFRQAPGKEREFVSAISGGGSETYYADSVKGRFTISRDNSKNTLYLQMNSLRAEDTAVYYCAAGGEEAGVGYWGQGTQVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 650 - protein, 337 aa, synthetic construct
EVQLLESGGGLVQPGGSLRLSCAASGFTFDEYTMHWFRQAPGKEREFVSAISGGGSETYYADSVKGRFTISRDNSKNTLYLQMNSLRAEDTAVYYCAAGGEEAGVGYWGQGTQVTVSSTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 651 - protein, 335 aa, synthetic construct
EVQLLESGGGLVQPGGSLRLSCAASGFTFDEYTMHWFRQAPGKEREFVSAISGGGSETYYADSVKGRFTISRDNSKNTLYLQMNSLRAEDTAVYYCAAGGEEAGVGYWGQGTQVTVSSIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 652 - protein, 334 aa, synthetic construct
EVQLLESGGGLVQPGGSLRLSCAASGFTFDEYTMHWFRQAPGKEREFVSAISGGGSETYYADSVKGRFTISRDNSKNTLYLQMNSLRAEDTAVYYCAAGGEEAGVGYWGQGTQVTVSSIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 653 - protein, 328 aa, synthetic construct
EVQLLESGGGLVQPGGSLRLSCAASGFTFDEYTMHWFRQAPGKEREFVSAISGGGSETYYADSVKGRFTISRDNSKNTLYLQMNSLRAEDTAVYYCAAGGEEAGVGYWGQGTQVTVSSIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 654 - protein, 338 aa, synthetic construct
EVQLLESGGGLVQPGGSLRLSCAASGFTFDEYTMHWFRQAPGKEREFVSAISGGGSETYYADSVKGRFTISRDNSKNTLYLQMNSLRAEDTAVYYCAAGGEEAGVGYWGQGTQVTVSSIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 655 - protein, 337 aa, synthetic construct
EVQLLESGGGLVQPGGSLRLSCAASGFTFDEYTMHWFRQAPGKEREFVSAISGGGSETYYADSVKGRFTISRDNSKNTLYLQMNSLRAEDTAVYYCAAGGEEAGVGYWGQGTQVTVSSIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 656 - protein, 331 aa, synthetic construct
EVQLLESGGGLVQPGGSLRLSCAASGFTFDEYTMHWFRQAPGKEREFVSAISGGGSETYYADSVKGRFTISRDNSKNTLYLQMNSLRAEDTAVYYCAAGGEEAGVGYWGQGTQVTVSSIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 657 - protein, 308 aa, synthetic construct
EVQLLESGGGLVQPGGSLRLSCAASGFTFDEYTMHWFRQAPGKEREFVSAISGGGSETYYADSVKGRFTISRDNSKNTLYLQMNSLRAEDTAVYYCAAGGEEAGVGYWGQGTQVTVSSESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 658 - protein, 307 aa, synthetic construct
EVQLLESGGGLVQPGGSLRLSCAASGFTFDEYTMHWFRQAPGKEREFVSAISGGGSETYYADSVKGRFTISRDNSKNTLYLQMNSLRAEDTAVYYCAAGGEEAGVGYWGQGTQVTVSSESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 659 - protein, 301 aa, synthetic construct
EVQLLESGGGLVQPGGSLRLSCAASGFTFDEYTMHWFRQAPGKEREFVSAISGGGSETYYADSVKGRFTISRDNSKNTLYLQMNSLRAEDTAVYYCAAGGEEAGVGYWGQGTQVTVSSESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 660 - protein, 311 aa, synthetic construct
EVQLLESGGGLVQPGGSLRLSCAASGFTFDEYTMHWFRQAPGKEREFVSAISGGGSETYYADSVKGRFTISRDNSKNTLYLQMNSLRAEDTAVYYCAAGGEEAGVGYWGQGTQVTVSSESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 661 - protein, 310 aa, synthetic construct
EVQLLESGGGLVQPGGSLRLSCAASGFTFDEYTMHWFRQAPGKEREFVSAISGGGSETYYADSVKGRFTISRDNSKNTLYLQMNSLRAEDTAVYYCAAGGEEAGVGYWGQGTQVTVSSESKYGPPCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 662 - protein, 304 aa, synthetic construct
EVQLLESGGGLVQPGGSLRLSCAASGFTFDEYTMHWFRQAPGKEREFVSAISGGGSETYYADSVKGRFTISRDNSKNTLYLQMNSLRAEDTAVYYCAAGGEEAGVGYWGQGTQVTVSSESKYGPPCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 663 - protein, 312 aa, synthetic construct
EVQLLESGGGLVQPGGSLRLSCAASGFTFDEYTMHWFRQAPGKEREFVSAISGGGSETYYADSVKGRFTISRDNSKNTLYLQMNSLRAEDTAVYYCAAGGEEAGVGYWGQGTQVTVSSLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 664 - protein, 311 aa, synthetic construct
EVQLLESGGGLVQPGGSLRLSCAASGFTFDEYTMHWFRQAPGKEREFVSAISGGGSETYYADSVKGRFTISRDNSKNTLYLQMNSLRAEDTAVYYCAAGGEEAGVGYWGQGTQVTVSSLEPKSCDKTHTCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 665 - protein, 305 aa, synthetic construct
EVQLLESGGGLVQPGGSLRLSCAASGFTFDEYTMHWFRQAPGKEREFVSAISGGGSETYYADSVKGRFTISRDNSKNTLYLQMNSLRAEDTAVYYCAAGGEEAGVGYWGQGTQVTVSSLEPKSCDKTHTCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 666 - protein, 315 aa, synthetic construct
EVQLLESGGGLVQPGGSLRLSCAASGFTFDEYTMHWFRQAPGKEREFVSAISGGGSETYYADSVKGRFTISRDNSKNTLYLQMNSLRAEDTAVYYCAAGGEEAGVGYWGQGTQVTVSSLEPKSCDKTHTCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 667 - protein, 314 aa, synthetic construct
EVQLLESGGGLVQPGGSLRLSCAASGFTFDEYTMHWFRQAPGKEREFVSAISGGGSETYYADSVKGRFTISRDNSKNTLYLQMNSLRAEDTAVYYCAAGGEEAGVGYWGQGTQVTVSSLEPKSCDKTHTCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 668 - protein, 308 aa, synthetic construct
EVQLLESGGGLVQPGGSLRLSCAASGFTFDEYTMHWFRQAPGKEREFVSAISGGGSETYYADSVKGRFTISRDNSKNTLYLQMNSLRAEDTAVYYCAAGGEEAGVGYWGQGTQVTVSSLEPKSCDKTHTCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 669 - protein, 343 aa, synthetic construct
EVQLLESGGGLVQPGGSLRLSCAASGFTFEDYAMSWFRQAPGKEREGVSAISGKGGSTYYADSVKGRFTISRDNSKNTLYLQMNSLRAEDTAVYYCAVLDEEAGAEGGYWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 670 - protein, 342 aa, synthetic construct
EVQLLESGGGLVQPGGSLRLSCAASGFTFEDYAMSWFRQAPGKEREGVSAISGKGGSTYYADSVKGRFTISRDNSKNTLYLQMNSLRAEDTAVYYCAVLDEEAGAEGGYWGQGTQVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 671 - protein, 336 aa, synthetic construct
EVQLLESGGGLVQPGGSLRLSCAASGFTFEDYAMSWFRQAPGKEREGVSAISGKGGSTYYADSVKGRFTISRDNSKNTLYLQMNSLRAEDTAVYYCAVLDEEAGAEGGYWGQGTQVTVSSTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 672 - protein, 346 aa, synthetic construct
EVQLLESGGGLVQPGGSLRLSCAASGFTFEDYAMSWFRQAPGKEREGVSAISGKGGSTYYADSVKGRFTISRDNSKNTLYLQMNSLRAEDTAVYYCAVLDEEAGAEGGYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 673 - protein, 345 aa, synthetic construct
EVQLLESGGGLVQPGGSLRLSCAASGFTFEDYAMSWFRQAPGKEREGVSAISGKGGSTYYADSVKGRFTISRDNSKNTLYLQMNSLRAEDTAVYYCAVLDEEAGAEGGYWGQGTQVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 674 - protein, 339 aa, synthetic construct
EVQLLESGGGLVQPGGSLRLSCAASGFTFEDYAMSWFRQAPGKEREGVSAISGKGGSTYYADSVKGRFTISRDNSKNTLYLQMNSLRAEDTAVYYCAVLDEEAGAEGGYWGQGTQVTVSSTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 675 - protein, 337 aa, synthetic construct
EVQLLESGGGLVQPGGSLRLSCAASGFTFEDYAMSWFRQAPGKEREGVSAISGKGGSTYYADSVKGRFTISRDNSKNTLYLQMNSLRAEDTAVYYCAVLDEEAGAEGGYWGQGTQVTVSSIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 676 - protein, 336 aa, synthetic construct
EVQLLESGGGLVQPGGSLRLSCAASGFTFEDYAMSWFRQAPGKEREGVSAISGKGGSTYYADSVKGRFTISRDNSKNTLYLQMNSLRAEDTAVYYCAVLDEEAGAEGGYWGQGTQVTVSSIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 677 - protein, 330 aa, synthetic construct
EVQLLESGGGLVQPGGSLRLSCAASGFTFEDYAMSWFRQAPGKEREGVSAISGKGGSTYYADSVKGRFTISRDNSKNTLYLQMNSLRAEDTAVYYCAVLDEEAGAEGGYWGQGTQVTVSSIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 678 - protein, 340 aa, synthetic construct
EVQLLESGGGLVQPGGSLRLSCAASGFTFEDYAMSWFRQAPGKEREGVSAISGKGGSTYYADSVKGRFTISRDNSKNTLYLQMNSLRAEDTAVYYCAVLDEEAGAEGGYWGQGTQVTVSSIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 679 - protein, 339 aa, synthetic construct
EVQLLESGGGLVQPGGSLRLSCAASGFTFEDYAMSWFRQAPGKEREGVSAISGKGGSTYYADSVKGRFTISRDNSKNTLYLQMNSLRAEDTAVYYCAVLDEEAGAEGGYWGQGTQVTVSSIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 680 - protein, 333 aa, synthetic construct
EVQLLESGGGLVQPGGSLRLSCAASGFTFEDYAMSWFRQAPGKEREGVSAISGKGGSTYYADSVKGRFTISRDNSKNTLYLQMNSLRAEDTAVYYCAVLDEEAGAEGGYWGQGTQVTVSSIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 681 - protein, 310 aa, synthetic construct
EVQLLESGGGLVQPGGSLRLSCAASGFTFEDYAMSWFRQAPGKEREGVSAISGKGGSTYYADSVKGRFTISRDNSKNTLYLQMNSLRAEDTAVYYCAVLDEEAGAEGGYWGQGTQVTVSSESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 682 - protein, 309 aa, synthetic construct
EVQLLESGGGLVQPGGSLRLSCAASGFTFEDYAMSWFRQAPGKEREGVSAISGKGGSTYYADSVKGRFTISRDNSKNTLYLQMNSLRAEDTAVYYCAVLDEEAGAEGGYWGQGTQVTVSSESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 683 - protein, 303 aa, synthetic construct
EVQLLESGGGLVQPGGSLRLSCAASGFTFEDYAMSWFRQAPGKEREGVSAISGKGGSTYYADSVKGRFTISRDNSKNTLYLQMNSLRAEDTAVYYCAVLDEEAGAEGGYWGQGTQVTVSSESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 684 - protein, 313 aa, synthetic construct
EVQLLESGGGLVQPGGSLRLSCAASGFTFEDYAMSWFRQAPGKEREGVSAISGKGGSTYYADSVKGRFTISRDNSKNTLYLQMNSLRAEDTAVYYCAVLDEEAGAEGGYWGQGTQVTVSSESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 685 - protein, 312 aa, synthetic construct
EVQLLESGGGLVQPGGSLRLSCAASGFTFEDYAMSWFRQAPGKEREGVSAISGKGGSTYYADSVKGRFTISRDNSKNTLYLQMNSLRAEDTAVYYCAVLDEEAGAEGGYWGQGTQVTVSSESKYGPPCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 686 - protein, 306 aa, synthetic construct
EVQLLESGGGLVQPGGSLRLSCAASGFTFEDYAMSWFRQAPGKEREGVSAISGKGGSTYYADSVKGRFTISRDNSKNTLYLQMNSLRAEDTAVYYCAVLDEEAGAEGGYWGQGTQVTVSSESKYGPPCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 687 - protein, 314 aa, synthetic construct
EVQLLESGGGLVQPGGSLRLSCAASGFTFEDYAMSWFRQAPGKEREGVSAISGKGGSTYYADSVKGRFTISRDNSKNTLYLQMNSLRAEDTAVYYCAVLDEEAGAEGGYWGQGTQVTVSSLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 688 - protein, 313 aa, synthetic construct
EVQLLESGGGLVQPGGSLRLSCAASGFTFEDYAMSWFRQAPGKEREGVSAISGKGGSTYYADSVKGRFTISRDNSKNTLYLQMNSLRAEDTAVYYCAVLDEEAGAEGGYWGQGTQVTVSSLEPKSCDKTHTCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 689 - protein, 307 aa, synthetic construct
EVQLLESGGGLVQPGGSLRLSCAASGFTFEDYAMSWFRQAPGKEREGVSAISGKGGSTYYADSVKGRFTISRDNSKNTLYLQMNSLRAEDTAVYYCAVLDEEAGAEGGYWGQGTQVTVSSLEPKSCDKTHTCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 690 - protein, 317 aa, synthetic construct
EVQLLESGGGLVQPGGSLRLSCAASGFTFEDYAMSWFRQAPGKEREGVSAISGKGGSTYYADSVKGRFTISRDNSKNTLYLQMNSLRAEDTAVYYCAVLDEEAGAEGGYWGQGTQVTVSSLEPKSCDKTHTCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 691 - protein, 316 aa, synthetic construct
EVQLLESGGGLVQPGGSLRLSCAASGFTFEDYAMSWFRQAPGKEREGVSAISGKGGSTYYADSVKGRFTISRDNSKNTLYLQMNSLRAEDTAVYYCAVLDEEAGAEGGYWGQGTQVTVSSLEPKSCDKTHTCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 692 - protein, 310 aa, synthetic construct
EVQLLESGGGLVQPGGSLRLSCAASGFTFEDYAMSWFRQAPGKEREGVSAISGKGGSTYYADSVKGRFTISRDNSKNTLYLQMNSLRAEDTAVYYCAVLDEEAGAEGGYWGQGTQVTVSSLEPKSCDKTHTCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 693 - protein, 343 aa, synthetic construct
EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 694 - protein, 342 aa, synthetic construct
EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 695 - protein, 336 aa, synthetic construct
EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 696 - protein, 346 aa, synthetic construct
EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 697 - protein, 345 aa, synthetic construct
EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 698 - protein, 339 aa, synthetic construct
EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 699 - protein, 337 aa, synthetic construct
EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 700 - protein, 336 aa, synthetic construct
EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 701 - protein, 330 aa, synthetic construct
EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 702 - protein, 340 aa, synthetic construct
EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 703 - protein, 339 aa, synthetic construct
EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 704 - protein, 333 aa, synthetic construct
EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 705 - protein, 310 aa, synthetic construct
EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 706 - protein, 309 aa, synthetic construct
EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 707 - protein, 303 aa, synthetic construct
EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 708 - protein, 313 aa, synthetic construct
EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 709 - protein, 312 aa, synthetic construct
EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSESKYGPPCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 710 - protein, 306 aa, synthetic construct
EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSESKYGPPCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 711 - protein, 314 aa, synthetic construct
EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 712 - protein, 313 aa, synthetic construct
EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSLEPKSCDKTHTCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 713 - protein, 307 aa, synthetic construct
EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSLEPKSCDKTHTCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 714 - protein, 317 aa, synthetic construct
EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSLEPKSCDKTHTCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 715 - protein, 316 aa, synthetic construct
EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSLEPKSCDKTHTCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 716 - protein, 310 aa, synthetic construct
EVQLLESGGGLVQPGGSLRLSCAASGFTFDRYAMSWFRQAPGKEREGVSAISTSGDSTYYADSVKGRFTISRDNSKNTLYLQMNSLRAEDTAVYYCAVLDEEAGAEGGYWGQGTQVTVSSLEPKSCDKTHTCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 717 - protein, 344 aa, synthetic construct
EVQLLESGGGLVQPGGSLRLSCAASGFTFASDAMSWYRQAPGKERELVSAISGSGGSTYYADSVKGRFTISRDNSKNTLYLQMNSLRAEDTAVYYCAAHDSGEAYLAFDYWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 718 - protein, 343 aa, synthetic construct
EVQLLESGGGLVQPGGSLRLSCAASGFTFASDAMSWYRQAPGKERELVSAISGSGGSTYYADSVKGRFTISRDNSKNTLYLQMNSLRAEDTAVYYCAAHDSGEAYLAFDYWGQGTQVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 719 - protein, 337 aa, synthetic construct
EVQLLESGGGLVQPGGSLRLSCAASGFTFASDAMSWYRQAPGKERELVSAISGSGGSTYYADSVKGRFTISRDNSKNTLYLQMNSLRAEDTAVYYCAAHDSGEAYLAFDYWGQGTQVTVSSTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 720 - protein, 347 aa, synthetic construct
EVQLLESGGGLVQPGGSLRLSCAASGFTFASDAMSWYRQAPGKERELVSAISGSGGSTYYADSVKGRFTISRDNSKNTLYLQMNSLRAEDTAVYYCAAHDSGEAYLAFDYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 721 - protein, 346 aa, synthetic construct
EVQLLESGGGLVQPGGSLRLSCAASGFTFASDAMSWYRQAPGKERELVSAISGSGGSTYYADSVKGRFTISRDNSKNTLYLQMNSLRAEDTAVYYCAAHDSGEAYLAFDYWGQGTQVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 722 - protein, 340 aa, synthetic construct
EVQLLESGGGLVQPGGSLRLSCAASGFTFASDAMSWYRQAPGKERELVSAISGSGGSTYYADSVKGRFTISRDNSKNTLYLQMNSLRAEDTAVYYCAAHDSGEAYLAFDYWGQGTQVTVSSTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 723 - protein, 338 aa, synthetic construct
EVQLLESGGGLVQPGGSLRLSCAASGFTFASDAMSWYRQAPGKERELVSAISGSGGSTYYADSVKGRFTISRDNSKNTLYLQMNSLRAEDTAVYYCAAHDSGEAYLAFDYWGQGTQVTVSSIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 724 - protein, 337 aa, synthetic construct
EVQLLESGGGLVQPGGSLRLSCAASGFTFASDAMSWYRQAPGKERELVSAISGSGGSTYYADSVKGRFTISRDNSKNTLYLQMNSLRAEDTAVYYCAAHDSGEAYLAFDYWGQGTQVTVSSIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 725 - protein, 331 aa, synthetic construct
EVQLLESGGGLVQPGGSLRLSCAASGFTFASDAMSWYRQAPGKERELVSAISGSGGSTYYADSVKGRFTISRDNSKNTLYLQMNSLRAEDTAVYYCAAHDSGEAYLAFDYWGQGTQVTVSSIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 726 - protein, 341 aa, synthetic construct
EVQLLESGGGLVQPGGSLRLSCAASGFTFASDAMSWYRQAPGKERELVSAISGSGGSTYYADSVKGRFTISRDNSKNTLYLQMNSLRAEDTAVYYCAAHDSGEAYLAFDYWGQGTQVTVSSIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 727 - protein, 340 aa, synthetic construct
EVQLLESGGGLVQPGGSLRLSCAASGFTFASDAMSWYRQAPGKERELVSAISGSGGSTYYADSVKGRFTISRDNSKNTLYLQMNSLRAEDTAVYYCAAHDSGEAYLAFDYWGQGTQVTVSSIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 728 - protein, 334 aa, synthetic construct
EVQLLESGGGLVQPGGSLRLSCAASGFTFASDAMSWYRQAPGKERELVSAISGSGGSTYYADSVKGRFTISRDNSKNTLYLQMNSLRAEDTAVYYCAAHDSGEAYLAFDYWGQGTQVTVSSIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 729 - protein, 311 aa, synthetic construct
EVQLLESGGGLVQPGGSLRLSCAASGFTFASDAMSWYRQAPGKERELVSAISGSGGSTYYADSVKGRFTISRDNSKNTLYLQMNSLRAEDTAVYYCAAHDSGEAYLAFDYWGQGTQVTVSSESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 730 - protein, 310 aa, synthetic construct
EVQLLESGGGLVQPGGSLRLSCAASGFTFASDAMSWYRQAPGKERELVSAISGSGGSTYYADSVKGRFTISRDNSKNTLYLQMNSLRAEDTAVYYCAAHDSGEAYLAFDYWGQGTQVTVSSESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 731 - protein, 304 aa, synthetic construct
EVQLLESGGGLVQPGGSLRLSCAASGFTFASDAMSWYRQAPGKERELVSAISGSGGSTYYADSVKGRFTISRDNSKNTLYLQMNSLRAEDTAVYYCAAHDSGEAYLAFDYWGQGTQVTVSSESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 732 - protein, 314 aa, synthetic construct
EVQLLESGGGLVQPGGSLRLSCAASGFTFASDAMSWYRQAPGKERELVSAISGSGGSTYYADSVKGRFTISRDNSKNTLYLQMNSLRAEDTAVYYCAAHDSGEAYLAFDYWGQGTQVTVSSESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 733 - protein, 313 aa, synthetic construct
EVQLLESGGGLVQPGGSLRLSCAASGFTFASDAMSWYRQAPGKERELVSAISGSGGSTYYADSVKGRFTISRDNSKNTLYLQMNSLRAEDTAVYYCAAHDSGEAYLAFDYWGQGTQVTVSSESKYGPPCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 734 - protein, 307 aa, synthetic construct
EVQLLESGGGLVQPGGSLRLSCAASGFTFASDAMSWYRQAPGKERELVSAISGSGGSTYYADSVKGRFTISRDNSKNTLYLQMNSLRAEDTAVYYCAAHDSGEAYLAFDYWGQGTQVTVSSESKYGPPCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 735 - protein, 315 aa, synthetic construct
EVQLLESGGGLVQPGGSLRLSCAASGFTFASDAMSWYRQAPGKERELVSAISGSGGSTYYADSVKGRFTISRDNSKNTLYLQMNSLRAEDTAVYYCAAHDSGEAYLAFDYWGQGTQVTVSSLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 736 - protein, 314 aa, synthetic construct
EVQLLESGGGLVQPGGSLRLSCAASGFTFASDAMSWYRQAPGKERELVSAISGSGGSTYYADSVKGRFTISRDNSKNTLYLQMNSLRAEDTAVYYCAAHDSGEAYLAFDYWGQGTQVTVSSLEPKSCDKTHTCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 737 - protein, 308 aa, synthetic construct
EVQLLESGGGLVQPGGSLRLSCAASGFTFASDAMSWYRQAPGKERELVSAISGSGGSTYYADSVKGRFTISRDNSKNTLYLQMNSLRAEDTAVYYCAAHDSGEAYLAFDYWGQGTQVTVSSLEPKSCDKTHTCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 738 - protein, 318 aa, synthetic construct
EVQLLESGGGLVQPGGSLRLSCAASGFTFASDAMSWYRQAPGKERELVSAISGSGGSTYYADSVKGRFTISRDNSKNTLYLQMNSLRAEDTAVYYCAAHDSGEAYLAFDYWGQGTQVTVSSLEPKSCDKTHTCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 739 - protein, 317 aa, synthetic construct
EVQLLESGGGLVQPGGSLRLSCAASGFTFASDAMSWYRQAPGKERELVSAISGSGGSTYYADSVKGRFTISRDNSKNTLYLQMNSLRAEDTAVYYCAAHDSGEAYLAFDYWGQGTQVTVSSLEPKSCDKTHTCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 740 - protein, 311 aa, synthetic construct
EVQLLESGGGLVQPGGSLRLSCAASGFTFASDAMSWYRQAPGKERELVSAISGSGGSTYYADSVKGRFTISRDNSKNTLYLQMNSLRAEDTAVYYCAAHDSGEAYLAFDYWGQGTQVTVSSLEPKSCDKTHTCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 741 - protein, 344 aa, synthetic construct
EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 742 - protein, 343 aa, synthetic construct
EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 743 - protein, 337 aa, synthetic construct
EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 744 - protein, 347 aa, synthetic construct
EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 745 - protein, 346 aa, synthetic construct
EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 746 - protein, 340 aa, synthetic construct
EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 747 - protein, 338 aa, synthetic construct
EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 748 - protein, 337 aa, synthetic construct
EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 749 - protein, 331 aa, synthetic construct
EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 750 - protein, 341 aa, synthetic construct
EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 751 - protein, 340 aa, synthetic construct
EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 752 - protein, 334 aa, synthetic construct
EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 753 - protein, 311 aa, synthetic construct
EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 754 - protein, 310 aa, synthetic construct
EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 755 - protein, 304 aa, synthetic construct
EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 756 - protein, 314 aa, synthetic construct
EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 757 - protein, 313 aa, synthetic construct
EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSESKYGPPCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 758 - protein, 307 aa, synthetic construct
EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSESKYGPPCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 759 - protein, 315 aa, synthetic construct
EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 760 - protein, 314 aa, synthetic construct
EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSLEPKSCDKTHTCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 761 - protein, 308 aa, synthetic construct
EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSLEPKSCDKTHTCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 762 - protein, 318 aa, synthetic construct
EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSLEPKSCDKTHTCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 763 - protein, 317 aa, synthetic construct
EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSLEPKSCDKTHTCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 764 - protein, 311 aa, synthetic construct
EVQLLESGGGLVQPGGSLRLSCAASGFTFDSYTMSWYRQAPGKERELVSAISGHGDSTYYADSVKGRFTISRDNSKNTLYLQMNSLRAEDTAVYYCTRISITTEWLAGDYWGQGTQVTVSSLEPKSCDKTHTCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 765 - protein, 346 aa, synthetic construct
EVQLLESGGGLVQPGGSLRLSCAASGFTFSSYAMSWFRQAPGKEREFVSFISGSGDSTYYADSVKGRFTISRDNSKNTLYLQMNSLRAEDTAVYYCTRWPYDFEEPSEPGVYWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 766 - protein, 345 aa, synthetic construct
EVQLLESGGGLVQPGGSLRLSCAASGFTFSSYAMSWFRQAPGKEREFVSFISGSGDSTYYADSVKGRFTISRDNSKNTLYLQMNSLRAEDTAVYYCTRWPYDFEEPSEPGVYWGQGTQVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 767 - protein, 339 aa, synthetic construct
EVQLLESGGGLVQPGGSLRLSCAASGFTFSSYAMSWFRQAPGKEREFVSFISGSGDSTYYADSVKGRFTISRDNSKNTLYLQMNSLRAEDTAVYYCTRWPYDFEEPSEPGVYWGQGTQVTVSSTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 768 - protein, 349 aa, synthetic construct
EVQLLESGGGLVQPGGSLRLSCAASGFTFSSYAMSWFRQAPGKEREFVSFISGSGDSTYYADSVKGRFTISRDNSKNTLYLQMNSLRAEDTAVYYCTRWPYDFEEPSEPGVYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 769 - protein, 348 aa, synthetic construct
EVQLLESGGGLVQPGGSLRLSCAASGFTFSSYAMSWFRQAPGKEREFVSFISGSGDSTYYADSVKGRFTISRDNSKNTLYLQMNSLRAEDTAVYYCTRWPYDFEEPSEPGVYWGQGTQVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 770 - protein, 342 aa, synthetic construct
EVQLLESGGGLVQPGGSLRLSCAASGFTFSSYAMSWFRQAPGKEREFVSFISGSGDSTYYADSVKGRFTISRDNSKNTLYLQMNSLRAEDTAVYYCTRWPYDFEEPSEPGVYWGQGTQVTVSSTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 771 - protein, 340 aa, synthetic construct
EVQLLESGGGLVQPGGSLRLSCAASGFTFSSYAMSWFRQAPGKEREFVSFISGSGDSTYYADSVKGRFTISRDNSKNTLYLQMNSLRAEDTAVYYCTRWPYDFEEPSEPGVYWGQGTQVTVSSIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 772 - protein, 339 aa, synthetic construct
EVQLLESGGGLVQPGGSLRLSCAASGFTFSSYAMSWFRQAPGKEREFVSFISGSGDSTYYADSVKGRFTISRDNSKNTLYLQMNSLRAEDTAVYYCTRWPYDFEEPSEPGVYWGQGTQVTVSSIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 773 - protein, 333 aa, synthetic construct
EVQLLESGGGLVQPGGSLRLSCAASGFTFSSYAMSWFRQAPGKEREFVSFISGSGDSTYYADSVKGRFTISRDNSKNTLYLQMNSLRAEDTAVYYCTRWPYDFEEPSEPGVYWGQGTQVTVSSIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 774 - protein, 343 aa, synthetic construct
EVQLLESGGGLVQPGGSLRLSCAASGFTFSSYAMSWFRQAPGKEREFVSFISGSGDSTYYADSVKGRFTISRDNSKNTLYLQMNSLRAEDTAVYYCTRWPYDFEEPSEPGVYWGQGTQVTVSSIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 775 - protein, 342 aa, synthetic construct
EVQLLESGGGLVQPGGSLRLSCAASGFTFSSYAMSWFRQAPGKEREFVSFISGSGDSTYYADSVKGRFTISRDNSKNTLYLQMNSLRAEDTAVYYCTRWPYDFEEPSEPGVYWGQGTQVTVSSIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 776 - protein, 336 aa, synthetic construct
EVQLLESGGGLVQPGGSLRLSCAASGFTFSSYAMSWFRQAPGKEREFVSFISGSGDSTYYADSVKGRFTISRDNSKNTLYLQMNSLRAEDTAVYYCTRWPYDFEEPSEPGVYWGQGTQVTVSSIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 777 - protein, 313 aa, synthetic construct
EVQLLESGGGLVQPGGSLRLSCAASGFTFSSYAMSWFRQAPGKEREFVSFISGSGDSTYYADSVKGRFTISRDNSKNTLYLQMNSLRAEDTAVYYCTRWPYDFEEPSEPGVYWGQGTQVTVSSESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 778 - protein, 312 aa, synthetic construct
EVQLLESGGGLVQPGGSLRLSCAASGFTFSSYAMSWFRQAPGKEREFVSFISGSGDSTYYADSVKGRFTISRDNSKNTLYLQMNSLRAEDTAVYYCTRWPYDFEEPSEPGVYWGQGTQVTVSSESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 779 - protein, 306 aa, synthetic construct
EVQLLESGGGLVQPGGSLRLSCAASGFTFSSYAMSWFRQAPGKEREFVSFISGSGDSTYYADSVKGRFTISRDNSKNTLYLQMNSLRAEDTAVYYCTRWPYDFEEPSEPGVYWGQGTQVTVSSESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 780 - protein, 316 aa, synthetic construct
EVQLLESGGGLVQPGGSLRLSCAASGFTFSSYAMSWFRQAPGKEREFVSFISGSGDSTYYADSVKGRFTISRDNSKNTLYLQMNSLRAEDTAVYYCTRWPYDFEEPSEPGVYWGQGTQVTVSSESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 781 - protein, 315 aa, synthetic construct
EVQLLESGGGLVQPGGSLRLSCAASGFTFSSYAMSWFRQAPGKEREFVSFISGSGDSTYYADSVKGRFTISRDNSKNTLYLQMNSLRAEDTAVYYCTRWPYDFEEPSEPGVYWGQGTQVTVSSESKYGPPCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 782 - protein, 309 aa, synthetic construct
EVQLLESGGGLVQPGGSLRLSCAASGFTFSSYAMSWFRQAPGKEREFVSFISGSGDSTYYADSVKGRFTISRDNSKNTLYLQMNSLRAEDTAVYYCTRWPYDFEEPSEPGVYWGQGTQVTVSSESKYGPPCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 783 - protein, 317 aa, synthetic construct
EVQLLESGGGLVQPGGSLRLSCAASGFTFSSYAMSWFRQAPGKEREFVSFISGSGDSTYYADSVKGRFTISRDNSKNTLYLQMNSLRAEDTAVYYCTRWPYDFEEPSEPGVYWGQGTQVTVSSLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 784 - protein, 316 aa, synthetic construct
EVQLLESGGGLVQPGGSLRLSCAASGFTFSSYAMSWFRQAPGKEREFVSFISGSGDSTYYADSVKGRFTISRDNSKNTLYLQMNSLRAEDTAVYYCTRWPYDFEEPSEPGVYWGQGTQVTVSSLEPKSCDKTHTCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 785 - protein, 310 aa, synthetic construct
EVQLLESGGGLVQPGGSLRLSCAASGFTFSSYAMSWFRQAPGKEREFVSFISGSGDSTYYADSVKGRFTISRDNSKNTLYLQMNSLRAEDTAVYYCTRWPYDFEEPSEPGVYWGQGTQVTVSSLEPKSCDKTHTCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 786 - protein, 320 aa, synthetic construct
EVQLLESGGGLVQPGGSLRLSCAASGFTFSSYAMSWFRQAPGKEREFVSFISGSGDSTYYADSVKGRFTISRDNSKNTLYLQMNSLRAEDTAVYYCTRWPYDFEEPSEPGVYWGQGTQVTVSSLEPKSCDKTHTCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 787 - protein, 319 aa, synthetic construct
EVQLLESGGGLVQPGGSLRLSCAASGFTFSSYAMSWFRQAPGKEREFVSFISGSGDSTYYADSVKGRFTISRDNSKNTLYLQMNSLRAEDTAVYYCTRWPYDFEEPSEPGVYWGQGTQVTVSSLEPKSCDKTHTCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 788 - protein, 313 aa, synthetic construct
EVQLLESGGGLVQPGGSLRLSCAASGFTFSSYAMSWFRQAPGKEREFVSFISGSGDSTYYADSVKGRFTISRDNSKNTLYLQMNSLRAEDTAVYYCTRWPYDFEEPSEPGVYWGQGTQVTVSSLEPKSCDKTHTCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 789 - protein, 346 aa, synthetic construct
EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 790 - protein, 345 aa, synthetic construct
EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 791 - protein, 339 aa, synthetic construct
EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 792 - protein, 349 aa, synthetic construct
EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 793 - protein, 348 aa, synthetic construct
EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 794 - protein, 342 aa, synthetic construct
EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 795 - protein, 340 aa, synthetic construct
EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 796 - protein, 339 aa, synthetic construct
EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 797 - protein, 333 aa, synthetic construct
EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 798 - protein, 343 aa, synthetic construct
EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 799 - protein, 342 aa, synthetic construct
EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 800 - protein, 336 aa, synthetic construct
EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 801 - protein, 313 aa, synthetic construct
EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 802 - protein, 312 aa, synthetic construct
EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 803 - protein, 306 aa, synthetic construct
EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 804 - protein, 316 aa, synthetic construct
EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 805 - protein, 315 aa, synthetic construct
EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSESKYGPPCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 806 - protein, 309 aa, synthetic construct
EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSESKYGPPCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 807 - protein, 317 aa, synthetic construct
EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 808 - protein, 316 aa, synthetic construct
EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSLEPKSCDKTHTCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 809 - protein, 310 aa, synthetic construct
EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSLEPKSCDKTHTCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 810 - protein, 320 aa, synthetic construct
EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSLEPKSCDKTHTCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 811 - protein, 319 aa, synthetic construct
EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSLEPKSCDKTHTCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 812 - protein, 313 aa, synthetic construct
EVQLLESGGGLVQPGGSLRLSCAASGFTFTDYDMSWYRQAPGKERELVSVIHSGGSTYYADSVKGRFTISRDNSKNTLYLQMNSLRAEDTAVYYCAPGYYSDLSFDYYNFDYWGQGTQVTVSSLEPKSCDKTHTCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 813 - protein, 346 aa, synthetic construct
EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 814 - protein, 345 aa, synthetic construct
EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 815 - protein, 339 aa, synthetic construct
EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 816 - protein, 349 aa, synthetic construct
EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 817 - protein, 348 aa, synthetic construct
EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 818 - protein, 342 aa, synthetic construct
EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 819 - protein, 340 aa, synthetic construct
EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 820 - protein, 339 aa, synthetic construct
EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 821 - protein, 333 aa, synthetic construct
EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 822 - protein, 343 aa, synthetic construct
EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 823 - protein, 342 aa, synthetic construct
EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 824 - protein, 336 aa, synthetic construct
EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 825 - protein, 313 aa, synthetic construct
EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 826 - protein, 312 aa, synthetic construct
EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 827 - protein, 306 aa, synthetic construct
EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 828 - protein, 316 aa, synthetic construct
EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 829 - protein, 315 aa, synthetic construct
EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSESKYGPPCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 830 - protein, 309 aa, synthetic construct
EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSESKYGPPCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 831 - protein, 317 aa, synthetic construct
EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 832 - protein, 316 aa, synthetic construct
EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSLEPKSCDKTHTCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 833 - protein, 310 aa, synthetic construct
EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSLEPKSCDKTHTCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 834 - protein, 320 aa, synthetic construct
EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSLEPKSCDKTHTCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 835 - protein, 319 aa, synthetic construct
EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSLEPKSCDKTHTCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 836 - protein, 313 aa, synthetic construct
EVQLLESGGGLVQPGGSLRLSCAASGFTFSDYAMHWFRQAPGKERVLVSSIDSGGSTYYADSVKGRFTISRDNSKNTLYLQMNSLRAEDTAVYYCNAGFKGDHPHPKDAFDIWGQGTQVTVSSLEPKSCDKTHTCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 837 - protein, 348 aa, synthetic construct
EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 838 - protein, 347 aa, synthetic construct
EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 839 - protein, 341 aa, synthetic construct
EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSTTTPAPRPPTPAPTIASQPLSLRPEACRPAAGGAVHTRGLDFACDIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 840 - protein, 351 aa, synthetic construct
EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSTTTPAPRPPTPAPTIASQPLSLRPEACRPAAGGAVHTRGLDFACDFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 841 - protein, 350 aa, synthetic construct
EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 842 - protein, 344 aa, synthetic construct
EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSTTTPAPRPPTPAPTIASQPLSLRPEACRPAAGGAVHTRGLDFACDFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 843 - protein, 342 aa, synthetic construct
EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSIEVMYPPPYLDNEKSNGTIIHVKGKHLCPSPLFPGPSKPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 844 - protein, 341 aa, synthetic construct
EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSIEVMYPPPYLDNEKSNGTIIHVKGKHLCPSPLFPGPSKPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 845 - protein, 335 aa, synthetic construct
EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSIEVMYPPPYLDNEKSNGTIIHVKGKHLCPSPLFPGPSKPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 846 - protein, 345 aa, synthetic construct
EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSIEVMYPPPYLDNEKSNGTIIHVKGKHLCPSPLFPGPSKPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 847 - protein, 344 aa, synthetic construct
EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 848 - protein, 338 aa, synthetic construct
EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSIEVMYPPPYLDNEKSNGTIIHVKGKHLCPSPLFPGPSKPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 849 - protein, 315 aa, synthetic construct
EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSESKYGPPCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 850 - protein, 314 aa, synthetic construct
EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSESKYGPPCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 851 - protein, 308 aa, synthetic construct
EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSESKYGPPCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 852 - protein, 318 aa, synthetic construct
EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSESKYGPPCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 853 - protein, 317 aa, synthetic construct
EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSESKYGPPCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 854 - protein, 311 aa, synthetic construct
EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSESKYGPPCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 855 - protein, 319 aa, synthetic construct
EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSLEPKSCDKTHTCPPCPIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 856 - protein, 318 aa, synthetic construct
EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSLEPKSCDKTHTCPPCPIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 857 - protein, 312 aa, synthetic construct
EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSLEPKSCDKTHTCPPCPIYIWAPLAGTCGVLLLSLVITLYCTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 858 - protein, 322 aa, synthetic construct
EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSLEPKSCDKTHTCPPCPFWVLVVVGGVLACYSLLVTVAFIIFWVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 859 - protein, 321 aa, synthetic construct
EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSLEPKSCDKTHTCPPCPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 860 - protein, 315 aa, synthetic construct
EVQLLESGGGLVQPGGSLRLSCAASGFTFSSEGMSWVRQAPGKERELVSAISGSGDHTYYADSVRGRFTISRDNSKNTLYLQMNSLRAEDTAVYYCNALEGGPTTAIQPGGPDYWGQGTQVTVSSLEPKSCDKTHTCPPCPFWVLVVVGGVLACYSLLVTVAFIIFWVTKKKYSSSVHDPNGEYMFMRAVNTAKKSRLTDVTLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 861 - protein, 21 aa, synthetic construct
MALPVTALLLPLALLLHAARP

SEQ ID NO: 862 - protein, 20 aa, synthetic construct
METDTLLLWVLLLWVPGSTG

SEQ ID NO: 863 - protein, 22 aa, synthetic construct
MDMRVPAQLLGLLLLWLRGARC

SEQ ID NO: 864 - protein, 16 aa, synthetic construct
MPLLLLLPLLWAGALA

SEQ ID NO: 865 - protein, 23 aa, synthetic construct
MDAMKRGLCCVLLLCGAVFVSPS

SEQ ID NO: 866 - protein, 17 aa, synthetic construct
MLLLLLLLGLRLQLSLG

SEQ ID NO: 867 - protein, 17 aa, synthetic construct
MWLQSLLLLGTVACSIS

SEQ ID NO: 868 - protein, 17 aa, synthetic construct
MGVKVLFALICIAVAEA

SEQ ID NO: 869 - protein, 22 aa, synthetic construct
MLLLVTSLLLCELPHPAFLLIP

SEQ ID NO: 870 - protein, 20 aa, synthetic construct
MSRSVALAVLALLSLSGLEA

SEQ ID NO: 871 - protein, 34 aa, synthetic construct
MGHTRRQGTSPSKCPYLNFFQLLVLAGLSHFCSG

SEQ ID NO: 872 - protein, 21 aa, synthetic construct
MWWRLWWLLLLLLLLWPMVWA

SEQ ID NO: 873 - protein, 16 aa, synthetic construct
MLLLLLLLLLLALALA

SEQ ID NO: 874 - DNA, 735 bp, synthetic construct
  source 1..735: mol_type = other DNA
gagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggcagcggctctggcaccgatttcaccctgaccataagcagcctggaacctgaggacttcgccgtgtactactgccagcagagagtggtgtaccccatcacctttggcggaggcaccaaggtggaaatcaaaggcggcggaggaagcggaggcggaggatctggtggtggtggatctggcggaggtggcagccagatcacactgaaagagtctggccccacactggtcaagcccacacagaccctgacactgacctgcaccttcagcggctttagcctgagcacatctggcgtcggcgttggctggattagacagcctcctggaaaggccctggaatggctggccctgatctactggaacgacgagaagagatacagccccagcctgaagtcccggctgaccatcaccaaggacaccagcaagaaccaggtggtgctgaccatgacaaacatggaccccgtggacaccgccgtgtattattgcgccagagatgagtacggcggcttcgacatttggggccagggcacaatggtcaccgtgtctagt

SEQ ID NO: 875 - DNA, 735 bp, synthetic construct
  source 1..735: mol_type = other DNA
gagatcgtgctgacccagtcccctgctaccctgagcctgtctccaggcgagcgggccacactgagctgtagagcttctcagagcgtgtccagctacctggcctggtatcagcagaaacctggccaggcccctagactgctgatctacgacgccagcaaccgggccaccggcatccccgccagattcagcggatctggcagcggcacagattttaccctcaccatcagcagcctggaacctgaggacttcgccgtctactactgccagcaaagattcgactaccccatcaccttcggcggcggaacaaaggtggaaattaagggtggtgggggcagcggtggaggtgggagcggaggcgggggtagcggaggcgggggtagccaaatcacactgaaagagagcggccctacactcgtgaaacctacccagaccctgacactgacatgtaccttcagcggcttctccctgagcacctctggcgtcggcgttggatggatcagacagcctccaggcaaggccctggaatggctggctctgatctattggaacgacgacaagcggtacagccccagcctgaagtctagactgaccatcacaaaggacaccagcaagaaccaggtggtgctgaccatgacaaatatggaccccgtggacaccgccgtgtactactgcgccagagatgagtacggcggatttgatatctggggccagggcaccatggtgaccgtgtccagc

SEQ ID NO: 876 - DNA, 729 bp, synthetic construct
  source 1..729: mol_type = other DNA
caagtgcagctcgtggaaagcggcggcggagtggtgcagcccggccggagcctgagactgtcctgcgccgcttctggatttaccttcagcagctacggcatgcactgggtcagacaggcccctggcaaaggcctggagtgggtggccgttatcagctacgagggcagcaacaagtattacgccgacagcgtgaagggccgcttcacaatctctagagataatagcaagaacaccctgtacctgcagatgaacagcctgcgggccgaagataccgccgtgtactactgtgctagagagctgggcgacggcatggacgtgtggggacagggcacaaccgtgaccgtgtcctctggtggtgggggcagcggtggaggtgggagcggaggcgggggtagcggaggcgggggtagcgagatcgtgctgacccagtcccctgctacactgagcctgtctccaggcgagcgggccacactgagctgtagagcttctcagagcgtgtccagctatctggcctggttccagcagaaacctggccaggcccctagactgctgatctacgacgccagcaaccgggccaccggcatccccgccagattcagcggctctggcagcggcaccgacttcaccctcaccatcagcagcctggaacccgaggattttgccgtctactactgccagcaaagagtggacctgtggaccttcggcggaggaacaaaggtggaaatcaag

SEQ ID NO: 877 - DNA, 735 bp, synthetic construct
  source 1..735: mol_type = other DNA
gacatccagatgacccagagcccttcgaccctatccgcttccgtgggtgaccgtgtgaccatcacctgtcgcgcgtcgcagagcatctcctcctggctcgcgtggtaccaacagaagcctggcaaggcccccaagctgctgatttacgacgccagttccctggagtctggcgtgccatcccgcttctccggcagcggcagcggtaccgagttcaccctgacgatcagctccctgcagccggatgactttgctacctactactgtcagcaggtctcctccctcccccccaccttcggtggcggtaccaaggtggagatcaagggcggcggcggctctggtggcggaggttctggcgggggaggttcgggggggggaggctccgaggtgcaactggtagagagcggcgggggactggtaaaacccggcggctccctgcggctgtcatgcgctgctagcggcttcacgttcagcgattactacatgagttggatccgccaggcccccgggaagggtttggagtgggtctcgtatatctcttccagcggatctaccatttactatgcggacagcgtgaaggggcgcttcaccatatctcgggacaacgccaagaactccctgtacctgcagatgaattccctgcgtgccgaggacacggccgtgtattactgtgcccgcgaccagggcaactacggcgtcgacgtgtggggccagggtacaaccgtcaccgtgtccagt

SEQ ID NO: 878 - DNA, 735 bp, synthetic construct
  source 1..735: mol_type = other DNA
caagtgcagctggtcgagagcggaggaggcctggttaagcccggcggatctctcagactgagctgcgccgctagcggctttacattcagcgactactacatgagctggatccggcaggcccctggcaagggcctggaatgggtgtcctacatcagctcctccggcagcaccatctactacgccgacagcgtgaaaggcagattcacaatctctagagataatgccaagaacagcctgtacctgcagatgaacagcctgcgggccgaggacaccgccgtgtactattgtgctagagatcagggcaactacggcgtggacgtgtggggccagggcaccaccgtgaccgtgtctagcggtggtgggggcagcggtggaggtgggagcggaggcgggggtagcggaggcgggggtagcgatatccagatgacccagtccccatctacactgagcgcctctgtgggcgaccgggtgaccattacatgtagagccagccagagcatcagcagctggctggcttggtatcagcagaaacctggcaaggcccctaagctgctgatctacgaggccagcagcctggaaagcggcgtccccagcagattcagcggcagcggctctggaacagagttcaccctgaccatctcctccctgcagcctgacgacttcgccacctactactgccagcaatctgatagccaccccatcacctttggcggaggcaccaaggtggaaatcaag

SEQ ID NO: 879 - DNA, 735 bp, synthetic construct
  source 1..735: mol_type = other DNA
gatatccagatgacccagtccccatctacactgagcgcctctgtgggcgaccgggtgacaattacctgtagagctagccagagcatctcctcctggctggcttggtaccagcaaaaacctggcaaggcccctaagctgctgatctacgaggccagcagcctggaaagcggcgtcccctctagattcagcggcagcggctctggaaccgagttcaccctgacaatcagcagcctgcagcctgacgacttcgccacctattactgccagcaggccaacagccaccccatcacctttggcggaggcaccaaggtggaaatcaagggtggtgggggcagcggtggaggtgggagcggaggcgggggtagcggaggcgggggtagcgaggtgcagctggtggaaagcggcggaggactcgttaagcccggcggcagcctgagactgagctgcgccgctagcggatttaccttcagcgactactacatgagctggatccggcaggcccctggcaagggcctggaatgggtcagctacatcagctcctctggctctacaatctactacgccgacagcgtgaaaggcagattcaccatctctagagataatgccaagaacagcctgtacctgcaaatgaacagcctgcgggccgaggacaccgccgtgtactattgtgctagagatcagggcaactacggcgtggacgtgtggggccagggcaccaccgtgacagtgtcctcc

SEQ ID NO: 880 - DNA, 747 bp, synthetic construct
  source 1..747: mol_type = other DNA
gacatccagatgacccagagccctagctccctgagcgccagcgtgggcgatagagtgaccattacctgtagagcctctcagagcatctcctcctacctgaactggtatcagcagaaacccggcaaggcccctaagctgctgatctacgccgctagcagcctgcagtctggcgtccccagccggttcagcggcagcggatctggcaccgacttcaccctgacaatcagcagcctgcaacctgaggactttgctacatactactgccagcaggcccacagctctccaatcaccttcggcggcggaacaaaggtggaaatcaagggtggtgggggcagcggtggaggtgggagcggaggcgggggtagcggaggcgggggtagcgaggtgcagctgctggaaagcggaggcggactcgttcaacctggcggcagcctgagactgagctgcgccgcttctggatttaccttcagcaactacgccatgagctgggtgcggcaggcccctggcaaaggcctggaatgggtctccgccatcagcggctctggcggctccacctactacgccgacagcgtgaagggcagattcaccatctctagagataatagcaagaacaccctgtacctgcagatgaacagcctgcgggccgaggacaccgccgtgtactattgtgctagacccggagatggctactacgagggcgtgtacttcgactactggggccagggcacactggtgacagtgtccagc

SEQ ID NO: 881 - DNA, 753 bp, synthetic construct
  source 1..753: mol_type = other DNA
gatattcagatgacccagagcccatctagcctgagcgccagcgtgggcgatagagtgaccatcacctgtcaggcctctcaggacatcgctaattacctgaactggtatcagcagaaacccggcaaggcccctaagctgctgatctacgacgcctccaacctggaaaccggcgtgcccagccggttcagcggcagcggatctggcacagacttcacctttaccatcagctccctccagcctgaggacatcgccacatactactgccagcaacacttcaacctgcctctgaccttcggcggcggaacaaaggtcgagatcaagggtggtgggggcagcggtggaggtgggagcggaggcgggggtagcggaggcgggggtagccaaatcaccctgaaagagagcggacctacactggtcaagcctacccagacactgaccctcacatgtacattcagcggctttagcctgagcacctccggcgtgggagtgggctggatcagacagccccccggcaaggccctggaatggctggctctgatctattggaatgacgagaagcggtacagccctagcctgaaatctagactgacaatcaccaaggacaccagcaagaaccaggtggtgctgaccatgaccaacatggatcctgtggataccgccgtgtactactgcgccagagaaggctctcacgactacaagagctccaactggttcgacccatggggccagggcaccctggttacagtgtctagc

SEQ ID NO: 882 - DNA, 765 bp, synthetic construct
  source 1..765: mol_type = other DNA
gatatcgtgatgacccaatctccactgagcctgcctgtgacacctggcgagcctgcttctatcagctgtagaagcagccagtccctgctgcacagcaacggctacaactacctggactggtatctgcagaaacccggccagagcccccagctgctgatctacctcggctctaatcgggccagcggagtgcctgatagattcagcggaagcggctccggcaccgacttcaccctgaagatcagcagagtggaagccgaggacgtgggcgtctactactgcatgcaggccctgggcctgattacatttggcggcggaaccaaggtggaaatcaagggtggtgggggcagcggtggaggtgggagcggaggcgggggtagcggaggcgggggtagcgaagtgcagctggttgagagcggcggcggactggtgaagcccggaggcagcctcagactgagctgtgctgcttctggctttaccttcagctcttatagcatgaactgggtgcggcaggcccctggcaagggcctggaatgggtcagctccatcagctcttctagcagctacatctactacgccgacagcgtgaagggcagattcaccatcagcagagataacgccaagaacagcctgtacctgcagatgaatagcctgcgggccgaggacaccgccgtgtactactgcgccagagccggcgacacctacagcgccgccgattactactacatggacgtgtggggcaaaggaacaaccgtgacagtgtcctcc

SEQ ID NO: 883 - DNA, 348 bp, synthetic construct
  source 1..348: mol_type = other DNA
gaagtgcaactgctggaaagcggcggaggcctggtccagcccggcggctctctgcggctcagctgcgccgcttctggatttaccttcggcagcgaggctatgagctgggtgcggcaggcccctggaaaagagagagagctggtgtccgccatcagcggcagcggcgaggtgacctactacgccgacagcgtgaagggcagattcaccatctctagagataatagcaagaacaccctgtacctgcagatgaacagcctgagagccgaggacaccgccgtgtactattgtcagagactggtggaagccaagcggcactggggccagggcacacaggttacagtgtccagc

SEQ ID NO: 884 - DNA, 348 bp, synthetic construct
  source 1..348: mol_type = other DNA
gaagtgcaactgctggaatctggcggaggactggtgcagcccggcggcagcctgcggctgagctgtgctgcttctggctttaccttcgagtctgaggccatgagctggtatagacaggcccctggcaaggaaagagagctggtcagcgtgatcaccagcgagggctccacctactacgccgacagcgtgaaaggcagattcacaatcagccgggacaatagcaagaacaccctgtacctgcagatgaacagcctgcgcgccgaagatacagccgtgtactactgcgcccacatcgagtgggagacaagactcaactggggccagggcacccaggtgaccgtgtccagc

SEQ ID NO: 885 - DNA, 354 bp, synthetic construct
  source 1..354: mol_type = other DNA
gaggtgcagctgctggaaagcggagggggcctggtccaacccggcgggtctcttcgcctaagctgtgccgcttctggcttcaccttcgacgagtacaccatgcactggttcagacaggcccccggcaaggagcgcgagttcgtcagtgcaatcagcggaggcggtagcgagacttattacgcggactccgtgaagggccgcttcaccattagccgcgacaactccaagaacacgctgtacctgcagatgaattcgctgcgcgccgaagatacggccgtgtactactgtgccgctggtggggaggaggctggcgtgggctattggggccagggcacccaggtcaccgtgtcgtcc

SEQ ID NO: 886 - DNA, 360 bp, synthetic construct
  source 1..360: mol_type = other DNA
gaggtgcagctgctggagagcggaggcggcctcgtgcagccaggaggttccctacgactctcctgtgccgccagcggcttcaccttcgaggactacgccatgagttggttccgccaggccccggggaaggagcgcgagggcgtgagcgcgatttctggaaagggcggctccacctattacgcggactccgtgaagggtcgctttaccatctctcgcgacaactccaagaacacgctgtacctgcagatgaatagcctgcgcgctgaggacactgccgtgtactactgtgctgtcttggacgaggaggccggcgcagagggcggctattggggccagggtacccaggtcaccgtgtcgtcc

SEQ ID NO: 887 - DNA, 360 bp, synthetic construct
  source 1..360: mol_type = other DNA
gaggtgcaactgctggaaagcggcggtggactggtgcagcccggcggcagcctgagactgtcttgtgctgcttctggatttacattcgacagatacgccatgagctggttccgccaggcccctggcaaagagcgggaaggcgtgtccgccatctccacaagcggagatagcacatactatgccgacagcgtgaagggcagattcaccatcagcagagataatagcaagaacaccctgtacctgcagatgaacagcctccgggccgaggacaccgccgtctactactgcgccgtgctggacgaggaagccggcgccgagggcggctactggggccagggcacccaggtgaccgtgtctagc

SEQ ID NO: 888 - DNA, 363 bp, synthetic construct
  source 1..363: mol_type = other DNA
gaggtgcaactgctggaaagcggcggaggactcgtccagcccggcggcagcctgcggctgagctgtgctgcttctggatttaccttcgccagcgacgccatgagctggtatagacaggcccctggcaaagagcgggaactggtgtccgccatcagcggctctggcggctccacctactacgccgatagcgtgaagggcagattcacaatctctagagataatagcaagaacaccctgtacctgcagatgaacagcctgagagccgaggacaccgccgtgtactactgcgccgctcacgacagcggcgaggcctacctggccttcgactactggggccagggcacacaggtgaccgtgtctagc

SEQ ID NO: 889 - DNA, 363 bp, synthetic construct
  source 1..363: mol_type = other DNA
gaggtgcaactgctggaaagcggcggaggactcgtccagcccggcggcagcctgaggctgagctgtgctgcttctggctttaccttcgactcctacacaatgagctggtatagacaggcccctggcaaggagcgggaactggtgtccgccatcagcggccacggcgactctacatactacgccgacagcgtgaaaggcagattcacaatctctagagataatagcaagaacaccctgtacctgcagatgaacagcctgcgggccgaggacaccgccgtgtactactgcaccagaatcagcatcaccaccgagtggctggccggagattactggggccagggcacccaggtgacagtgtccagc

SEQ ID NO: 890 - DNA, 369 bp, synthetic construct
  source 1..369: mol_type = other DNA
gaggtgcagctgctggaaagcggaggaggcctggtccaacctggcggcagcctgcggctgagctgcgccgcttctggcttcaccttcagcagctacgccatgagctggttccggcaggcccctggcaaggaaagagagttcgtgtcttttatcagcggatctggcgactccacctactacgctgatagcgtgaaaggcagatttaccatctctagagataatagcaagaacaccctgtacctccagatgaacagcctgcgcgccgaggacacagccgtgtactattgtaccagatggccttacgacttcgaggaaccaagcgagcccggcgtgtactggggccagggcacacaggtgacagtgtcctcc

SEQ ID NO: 891 - DNA, 369 bp, synthetic construct
  source 1..369: mol_type = other DNA
gaggtgcagctgctggaaagcggcggaggcctggtgcaacctggcggatctctcagactgagctgtgctgcttctggcttcacattcaccgactacgacatgagctggtatagacaggcccctggaaaagagcgggaactggtctccgtgatccacagcggcggctccacctactacgccgatagcgtgaagggcagattcaccatcagcagagataatagcaagaacaccctgtacctgcagatgaacagcctgcgggccgaggacaccgccgtgtactactgcgcccccggctactacagcgacctgtcttttgattattacaacttcgactactggggccagggcacacaggtgacagtgtccagc

SEQ ID NO: 892 - DNA, 369 bp, synthetic construct
  source 1..369: mol_type = other DNA
gaggtgcagctgctggagagcggtggagggttggtgcagcccgggggtagcctgcgtctgtcgtgcgccgcttccggcttcacgttctctgattacgccatgcactggttccggcaggcccccggtaaggagcgcgtgctggtgtcgtctattgactccggcggctccacttactacgcagacagtgtcaagggccgtttcaccatcagccgcgacaacagcaagaacacgctgtacctgcagatgaactcccttcgagcagaggacaccgcggtgtactactgtaatgcgggcttcaagggcgatcacccccaccccaaggatgccttcgacatttggggccagggcacccaggtcaccgtgtcgtcc

SEQ ID NO: 893 - DNA, 375 bp, synthetic construct
  source 1..375: mol_type = other DNA
gaggtgcaactgctggaatccggcggaggcctggtgcagcccggcggcagcctcagactgagctgtgccgcttctggctttaccttcagcagcgagggcatgagctgggtgcggcaggcccctggcaaggaaagagagctggtctccgccatcagcggatctggcgaccacacctactatgccgatagcgtgcgcggaagattcacaatctctagagataatagcaagaacaccctgtacctgcagatgaacagcctgcgggccgaggacaccgccgtgtactactgcaacgccctggaaggcggccctacaacagctatccagccaggaggccctgactactggggccagggcacccaggtgaccgtgtccagc

SEQ ID NO: 894 - DNA, 135 bp, synthetic construct
  source 1..135: mol_type = other DNA
accacaacacctgctccaaggccccccacacccgctccaactatagccagccaaccattgagcctcagacctgaagcttgcaggcccgcagcaggaggcgccgtccatacgcgaggcctggacttcgcgtgtgat

SEQ ID NO: 895 - DNA, 117 bp, synthetic construct
  source 1..117: mol_type = other DNA
attgaagttatgtatcctcctccttacctagacaatgagaagagcaatggaaccattatccatgtgaaagggaaacacctttgtccaagtcccctatttcccggaccttctaagccc

SEQ ID NO: 896 - DNA, 36 bp, synthetic construct
  source 1..36: mol_type = other DNA
gagtccaaatatggtcccccgtgcccaccatgccca

SEQ ID NO: 897 - DNA, 48 bp, synthetic construct
  source 1..48: mol_type = other DNA
cttgagcccaaatcttgtgacaaaactcacacatgcccaccgtgccca

SEQ ID NO: 898 - DNA, 72 bp, synthetic construct
  source 1..72: mol_type = other DNA
atttatatttgggcacctttggccggaacatgtggggtgttgcttctctcccttgtgatcactctgtattgt

SEQ ID NO: 899 - DNA, 81 bp, synthetic construct
  source 1..81: mol_type = other DNA
ttttgggtgctggtggtggttggtggagtcctggcttgctatagcttgctagtaacagtggcctttattattttctgggtg

SEQ ID NO: 900 - DNA, 126 bp, synthetic construct
  source 1..126: mol_type = other DNA
aagcgcgggagaaagaagctcctgtacatcttcaagcagccttttatgcgacctgtgcaaaccactcaggaagaagatgggtgttcatgccgcttccccgaggaggaagaaggagggtgtgaactg

SEQ ID NO: 901 - DNA, 123 bp, synthetic construct
  source 1..123: mol_type = other DNA
aggagtaagaggagcaggctcctgcacagtgactacatgaacatgactccccgccgccccgggcccacccgcaagcattaccagccctatgccccaccacgcgacttcgcagcctatcgctcc

SEQ ID NO: 902 - DNA, 105 bp, synthetic construct
  source 1..105: mol_type = other DNA
acaaaaaagaagtattcatccagtgtgcacgaccctaacggtgaatacatgttcatgagagcagtgaacacagccaaaaaatctagactcacagatgtgacccta

SEQ ID NO: 903 - DNA, 336 bp, synthetic construct
  source 1..336: mol_type = other DNA
agggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 904 - DNA, 63 bp, synthetic construct
  source 1..63: mol_type = other DNA
atggctcttcccgtaacagcccttttgttgccccttgcactccttctgcatgcagcacgaccg

SEQ ID NO: 905 - DNA, 1404 bp, synthetic construct
  source 1..1404: mol_type = other DNA
gagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggcagcggctctggcaccgatttcaccctgaccataagcagcctggaacctgaggacttcgccgtgtactactgccagcagagagtggtgtaccccatcacctttggcggaggcaccaaggtggaaatcaaaggcggcggaggaagcggaggcggaggatctggtggtggtggatctggcggaggtggcagccagatcacactgaaagagtctggccccacactggtcaagcccacacagaccctgacactgacctgcaccttcagcggctttagcctgagcacatctggcgtcggcgttggctggattagacagcctcctggaaaggccctggaatggctggccctgatctactggaacgacgagaagagatacagccccagcctgaagtcccggctgaccatcaccaaggacaccagcaagaaccaggtggtgctgaccatgacaaacatggaccccgtggacaccgccgtgtattattgcgccagagatgagtacggcggcttcgacatttggggccagggcacaatggtcaccgtgtctagtaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 906 - DNA, 1404 bp, synthetic construct
  source 1..1404: mol_type = other DNA
gagatcgtgctgacccagtcccctgctaccctgagcctgtctccaggcgagcgggccacactgagctgtagagcttctcagagcgtgtccagctacctggcctggtatcagcagaaacctggccaggcccctagactgctgatctacgacgccagcaaccgggccaccggcatccccgccagattcagcggatctggcagcggcacagattttaccctcaccatcagcagcctggaacctgaggacttcgccgtctactactgccagcaaagattcgactaccccatcaccttcggcggcggaacaaaggtggaaattaagggtggtgggggcagcggtggaggtgggagcggaggcgggggtagcggaggcgggggtagccaaatcacactgaaagagagcggccctacactcgtgaaacctacccagaccctgacactgacatgtaccttcagcggcttctccctgagcacctctggcgtcggcgttggatggatcagacagcctccaggcaaggccctggaatggctggctctgatctattggaacgacgacaagcggtacagccccagcctgaagtctagactgaccatcacaaaggacaccagcaagaaccaggtggtgctgaccatgacaaatatggaccccgtggacaccgccgtgtactactgcgccagagatgagtacggcggatttgatatctggggccagggcaccatggtgaccgtgtccagcaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 907 - DNA, 1398 bp, synthetic construct
  source 1..1398: mol_type = other DNA
caagtgcagctcgtggaaagcggcggcggagtggtgcagcccggccggagcctgagactgtcctgcgccgcttctggatttaccttcagcagctacggcatgcactgggtcagacaggcccctggcaaaggcctggagtgggtggccgttatcagctacgagggcagcaacaagtattacgccgacagcgtgaagggccgcttcacaatctctagagataatagcaagaacaccctgtacctgcagatgaacagcctgcgggccgaagataccgccgtgtactactgtgctagagagctgggcgacggcatggacgtgtggggacagggcacaaccgtgaccgtgtcctctggtggtgggggcagcggtggaggtgggagcggaggcgggggtagcggaggcgggggtagcgagatcgtgctgacccagtcccctgctacactgagcctgtctccaggcgagcgggccacactgagctgtagagcttctcagagcgtgtccagctatctggcctggttccagcagaaacctggccaggcccctagactgctgatctacgacgccagcaaccgggccaccggcatccccgccagattcagcggctctggcagcggcaccgacttcaccctcaccatcagcagcctggaacccgaggattttgccgtctactactgccagcaaagagtggacctgtggaccttcggcggaggaacaaaggtggaaatcaagaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 908 - DNA, 1404 bp, synthetic construct
  source 1..1404: mol_type = other DNA
gacatccagatgacccagagcccttcgaccctatccgcttccgtgggtgaccgtgtgaccatcacctgtcgcgcgtcgcagagcatctcctcctggctcgcgtggtaccaacagaagcctggcaaggcccccaagctgctgatttacgacgccagttccctggagtctggcgtgccatcccgcttctccggcagcggcagcggtaccgagttcaccctgacgatcagctccctgcagccggatgactttgctacctactactgtcagcaggtctcctccctcccccccaccttcggtggcggtaccaaggtggagatcaagggcggcggcggctctggtggcggaggttctggcgggggaggttcgggggggggaggctccgaggtgcaactggtagagagcggcgggggactggtaaaacccggcggctccctgcggctgtcatgcgctgctagcggcttcacgttcagcgattactacatgagttggatccgccaggcccccgggaagggtttggagtgggtctcgtatatctcttccagcggatctaccatttactatgcggacagcgtgaaggggcgcttcaccatatctcgggacaacgccaagaactccctgtacctgcagatgaattccctgcgtgccgaggacacggccgtgtattactgtgcccgcgaccagggcaactacggcgtcgacgtgtggggccagggtacaaccgtcaccgtgtccagtaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 909 - DNA, 1404 bp, synthetic construct
  source 1..1404: mol_type = other DNA
caagtgcagctggtcgagagcggaggaggcctggttaagcccggcggatctctcagactgagctgcgccgctagcggctttacattcagcgactactacatgagctggatccggcaggcccctggcaagggcctggaatgggtgtcctacatcagctcctccggcagcaccatctactacgccgacagcgtgaaaggcagattcacaatctctagagataatgccaagaacagcctgtacctgcagatgaacagcctgcgggccgaggacaccgccgtgtactattgtgctagagatcagggcaactacggcgtggacgtgtggggccagggcaccaccgtgaccgtgtctagcggtggtgggggcagcggtggaggtgggagcggaggcgggggtagcggaggcgggggtagcgatatccagatgacccagtccccatctacactgagcgcctctgtgggcgaccgggtgaccattacatgtagagccagccagagcatcagcagctggctggcttggtatcagcagaaacctggcaaggcccctaagctgctgatctacgaggccagcagcctggaaagcggcgtccccagcagattcagcggcagcggctctggaacagagttcaccctgaccatctcctccctgcagcctgacgacttcgccacctactactgccagcaatctgatagccaccccatcacctttggcggaggcaccaaggtggaaatcaagaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 910 - DNA, 1404 bp, synthetic construct
  source 1..1404: mol_type = other DNA
gatatccagatgacccagtccccatctacactgagcgcctctgtgggcgaccgggtgacaattacctgtagagctagccagagcatctcctcctggctggcttggtaccagcaaaaacctggcaaggcccctaagctgctgatctacgaggccagcagcctggaaagcggcgtcccctctagattcagcggcagcggctctggaaccgagttcaccctgacaatcagcagcctgcagcctgacgacttcgccacctattactgccagcaggccaacagccaccccatcacctttggcggaggcaccaaggtggaaatcaagggtggtgggggcagcggtggaggtgggagcggaggcgggggtagcggaggcgggggtagcgaggtgcagctggtggaaagcggcggaggactcgttaagcccggcggcagcctgagactgagctgcgccgctagcggatttaccttcagcgactactacatgagctggatccggcaggcccctggcaagggcctggaatgggtcagctacatcagctcctctggctctacaatctactacgccgacagcgtgaaaggcagattcaccatctctagagataatgccaagaacagcctgtacctgcaaatgaacagcctgcgggccgaggacaccgccgtgtactattgtgctagagatcagggcaactacggcgtggacgtgtggggccagggcaccaccgtgacagtgtcctccaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 911 - DNA, 1416 bp, synthetic construct
  source 1..1416: mol_type = other DNA
gacatccagatgacccagagccctagctccctgagcgccagcgtgggcgatagagtgaccattacctgtagagcctctcagagcatctcctcctacctgaactggtatcagcagaaacccggcaaggcccctaagctgctgatctacgccgctagcagcctgcagtctggcgtccccagccggttcagcggcagcggatctggcaccgacttcaccctgacaatcagcagcctgcaacctgaggactttgctacatactactgccagcaggcccacagctctccaatcaccttcggcggcggaacaaaggtggaaatcaagggtggtgggggcagcggtggaggtgggagcggaggcgggggtagcggaggcgggggtagcgaggtgcagctgctggaaagcggaggcggactcgttcaacctggcggcagcctgagactgagctgcgccgcttctggatttaccttcagcaactacgccatgagctgggtgcggcaggcccctggcaaaggcctggaatgggtctccgccatcagcggctctggcggctccacctactacgccgacagcgtgaagggcagattcaccatctctagagataatagcaagaacaccctgtacctgcagatgaacagcctgcgggccgaggacaccgccgtgtactattgtgctagacccggagatggctactacgagggcgtgtacttcgactactggggccagggcacactggtgacagtgtccagcaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 912 - DNA, 1422 bp, synthetic construct
  source 1..1422: mol_type = other DNA
gatattcagatgacccagagcccatctagcctgagcgccagcgtgggcgatagagtgaccatcacctgtcaggcctctcaggacatcgctaattacctgaactggtatcagcagaaacccggcaaggcccctaagctgctgatctacgacgcctccaacctggaaaccggcgtgcccagccggttcagcggcagcggatctggcacagacttcacctttaccatcagctccctccagcctgaggacatcgccacatactactgccagcaacacttcaacctgcctctgaccttcggcggcggaacaaaggtcgagatcaagggtggtgggggcagcggtggaggtgggagcggaggcgggggtagcggaggcgggggtagccaaatcaccctgaaagagagcggacctacactggtcaagcctacccagacactgaccctcacatgtacattcagcggctttagcctgagcacctccggcgtgggagtgggctggatcagacagccccccggcaaggccctggaatggctggctctgatctattggaatgacgagaagcggtacagccctagcctgaaatctagactgacaatcaccaaggacaccagcaagaaccaggtggtgctgaccatgaccaacatggatcctgtggataccgccgtgtactactgcgccagagaaggctctcacgactacaagagctccaactggttcgacccatggggccagggcaccctggttacagtgtctagcaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 913 - DNA, 1434 bp, synthetic construct
  source 1..1434: mol_type = other DNA
gatatcgtgatgacccaatctccactgagcctgcctgtgacacctggcgagcctgcttctatcagctgtagaagcagccagtccctgctgcacagcaacggctacaactacctggactggtatctgcagaaacccggccagagcccccagctgctgatctacctcggctctaatcgggccagcggagtgcctgatagattcagcggaagcggctccggcaccgacttcaccctgaagatcagcagagtggaagccgaggacgtgggcgtctactactgcatgcaggccctgggcctgattacatttggcggcggaaccaaggtggaaatcaagggtggtgggggcagcggtggaggtgggagcggaggcgggggtagcggaggcgggggtagcgaagtgcagctggttgagagcggcggcggactggtgaagcccggaggcagcctcagactgagctgtgctgcttctggctttaccttcagctcttatagcatgaactgggtgcggcaggcccctggcaagggcctggaatgggtcagctccatcagctcttctagcagctacatctactacgccgacagcgtgaagggcagattcaccatcagcagagataacgccaagaacagcctgtacctgcagatgaatagcctgcgggccgaggacaccgccgtgtactactgcgccagagccggcgacacctacagcgccgccgattactactacatggacgtgtggggcaaaggaacaaccgtgacagtgtcctccaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 914 - DNA, 1017 bp, synthetic construct
  source 1..1017: mol_type = other DNA
gaagtgcaactgctggaaagcggcggaggcctggtccagcccggcggctctctgcggctcagctgcgccgcttctggatttaccttcggcagcgaggctatgagctgggtgcggcaggcccctggaaaagagagagagctggtgtccgccatcagcggcagcggcgaggtgacctactacgccgacagcgtgaagggcagattcaccatctctagagataatagcaagaacaccctgtacctgcagatgaacagcctgagagccgaggacaccgccgtgtactattgtcagagactggtggaagccaagcggcactggggccagggcacacaggttacagtgtccagcaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 915 - DNA, 1017 bp, synthetic construct
  source 1..1017: mol_type = other DNA
gaagtgcaactgctggaatctggcggaggactggtgcagcccggcggcagcctgcggctgagctgtgctgcttctggctttaccttcgagtctgaggccatgagctggtatagacaggcccctggcaaggaaagagagctggtcagcgtgatcaccagcgagggctccacctactacgccgacagcgtgaaaggcagattcacaatcagccgggacaatagcaagaacaccctgtacctgcagatgaacagcctgcgcgccgaagatacagccgtgtactactgcgcccacatcgagtgggagacaagactcaactggggccagggcacccaggtgaccgtgtccagcaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 916 - DNA, 1023 bp, synthetic construct
  source 1..1023: mol_type = other DNA
gaggtgcagctgctggaaagcggagggggcctggtccaacccggcgggtctcttcgcctaagctgtgccgcttctggcttcaccttcgacgagtacaccatgcactggttcagacaggcccccggcaaggagcgcgagttcgtcagtgcaatcagcggaggcggtagcgagacttattacgcggactccgtgaagggccgcttcaccattagccgcgacaactccaagaacacgctgtacctgcagatgaattcgctgcgcgccgaagatacggccgtgtactactgtgccgctggtggggaggaggctggcgtgggctattggggccagggcacccaggtcaccgtgtcgtccaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 917 - DNA, 1029 bp, synthetic construct
  source 1..1029: mol_type = other DNA
gaggtgcagctgctggagagcggaggcggcctcgtgcagccaggaggttccctacgactctcctgtgccgccagcggcttcaccttcgaggactacgccatgagttggttccgccaggccccggggaaggagcgcgagggcgtgagcgcgatttctggaaagggcggctccacctattacgcggactccgtgaagggtcgctttaccatctctcgcgacaactccaagaacacgctgtacctgcagatgaatagcctgcgcgctgaggacactgccgtgtactactgtgctgtcttggacgaggaggccggcgcagagggcggctattggggccagggtacccaggtcaccgtgtcgtccaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 918 - DNA, 1029 bp, synthetic construct
  source 1..1029: mol_type = other DNA
gaggtgcaactgctggaaagcggcggtggactggtgcagcccggcggcagcctgagactgtcttgtgctgcttctggatttacattcgacagatacgccatgagctggttccgccaggcccctggcaaagagcgggaaggcgtgtccgccatctccacaagcggagatagcacatactatgccgacagcgtgaagggcagattcaccatcagcagagataatagcaagaacaccctgtacctgcagatgaacagcctccgggccgaggacaccgccgtctactactgcgccgtgctggacgaggaagccggcgccgagggcggctactggggccagggcacccaggtgaccgtgtctagcaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 919 - DNA, 1032 bp, synthetic construct
  source 1..1032: mol_type = other DNA
gaggtgcaactgctggaaagcggcggaggactcgtccagcccggcggcagcctgcggctgagctgtgctgcttctggatttaccttcgccagcgacgccatgagctggtatagacaggcccctggcaaagagcgggaactggtgtccgccatcagcggctctggcggctccacctactacgccgatagcgtgaagggcagattcacaatctctagagataatagcaagaacaccctgtacctgcagatgaacagcctgagagccgaggacaccgccgtgtactactgcgccgctcacgacagcggcgaggcctacctggccttcgactactggggccagggcacacaggtgaccgtgtctagcaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 920 - DNA, 1032 bp, synthetic construct
  source 1..1032: mol_type = other DNA
gaggtgcaactgctggaaagcggcggaggactcgtccagcccggcggcagcctgaggctgagctgtgctgcttctggctttaccttcgactcctacacaatgagctggtatagacaggcccctggcaaggagcgggaactggtgtccgccatcagcggccacggcgactctacatactacgccgacagcgtgaaaggcagattcacaatctctagagataatagcaagaacaccctgtacctgcagatgaacagcctgcgggccgaggacaccgccgtgtactactgcaccagaatcagcatcaccaccgagtggctggccggagattactggggccagggcacccaggtgacagtgtccagcaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 921 - DNA, 1038 bp, synthetic construct
  source 1..1038: mol_type = other DNA
gaggtgcagctgctggaaagcggaggaggcctggtccaacctggcggcagcctgcggctgagctgcgccgcttctggcttcaccttcagcagctacgccatgagctggttccggcaggcccctggcaaggaaagagagttcgtgtcttttatcagcggatctggcgactccacctactacgctgatagcgtgaaaggcagatttaccatctctagagataatagcaagaacaccctgtacctccagatgaacagcctgcgcgccgaggacacagccgtgtactattgtaccagatggccttacgacttcgaggaaccaagcgagcccggcgtgtactggggccagggcacacaggtgacagtgtcctccaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 922 - DNA, 1038 bp, synthetic construct
  source 1..1038: mol_type = other DNA
gaggtgcagctgctggaaagcggcggaggcctggtgcaacctggcggatctctcagactgagctgtgctgcttctggcttcacattcaccgactacgacatgagctggtatagacaggcccctggaaaagagcgggaactggtctccgtgatccacagcggcggctccacctactacgccgatagcgtgaagggcagattcaccatcagcagagataatagcaagaacaccctgtacctgcagatgaacagcctgcgggccgaggacaccgccgtgtactactgcgcccccggctactacagcgacctgtcttttgattattacaacttcgactactggggccagggcacacaggtgacagtgtccagcaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 923 - DNA, 1038 bp, synthetic construct
  source 1..1038: mol_type = other DNA
gaggtgcagctgctggagagcggtggagggttggtgcagcccgggggtagcctgcgtctgtcgtgcgccgcttccggcttcacgttctctgattacgccatgcactggttccggcaggcccccggtaaggagcgcgtgctggtgtcgtctattgactccggcggctccacttactacgcagacagtgtcaagggccgtttcaccatcagccgcgacaacagcaagaacacgctgtacctgcagatgaactcccttcgagcagaggacaccgcggtgtactactgtaatgcgggcttcaagggcgatcacccccaccccaaggatgccttcgacatttggggccagggcacccaggtcaccgtgtcgtccaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 924 - DNA, 1044 bp, synthetic construct
  source 1..1044: mol_type = other DNA
gaggtgcaactgctggaatccggcggaggcctggtgcagcccggcggcagcctcagactgagctgtgccgcttctggctttaccttcagcagcgagggcatgagctgggtgcggcaggcccctggcaaggaaagagagctggtctccgccatcagcggatctggcgaccacacctactatgccgatagcgtgcgcggaagattcacaatctctagagataatagcaagaacaccctgtacctgcagatgaacagcctgcgggccgaggacaccgccgtgtactactgcaacgccctggaaggcggccctacaacagctatccagccaggaggccctgactactggggccagggcacccaggtgaccgtgtccagcaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 925 - DNA, 1467 bp, synthetic construct
  source 1..1467: mol_type = other DNA
atggctcttcccgtaacagcccttttgttgccccttgcactccttctgcatgcagcacgaccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggcagcggctctggcaccgatttcaccctgaccataagcagcctggaacctgaggacttcgccgtgtactactgccagcagagagtggtgtaccccatcacctttggcggaggcaccaaggtggaaatcaaaggcggcggaggaagcggaggcggaggatctggtggtggtggatctggcggaggtggcagccagatcacactgaaagagtctggccccacactggtcaagcccacacagaccctgacactgacctgcaccttcagcggctttagcctgagcacatctggcgtcggcgttggctggattagacagcctcctggaaaggccctggaatggctggccctgatctactggaacgacgagaagagatacagccccagcctgaagtcccggctgaccatcaccaaggacaccagcaagaaccaggtggtgctgaccatgacaaacatggaccccgtggacaccgccgtgtattattgcgccagagatgagtacggcggcttcgacatttggggccagggcacaatggtcaccgtgtctagtaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 926 - DNA, 1467 bp, synthetic construct
  source 1..1467: mol_type = other DNA
atggctcttcccgtaacagcccttttgttgccccttgcactccttctgcatgcagcacgaccggagatcgtgctgacccagtcccctgctaccctgagcctgtctccaggcgagcgggccacactgagctgtagagcttctcagagcgtgtccagctacctggcctggtatcagcagaaacctggccaggcccctagactgctgatctacgacgccagcaaccgggccaccggcatccccgccagattcagcggatctggcagcggcacagattttaccctcaccatcagcagcctggaacctgaggacttcgccgtctactactgccagcaaagattcgactaccccatcaccttcggcggcggaacaaaggtggaaattaagggtggtgggggcagcggtggaggtgggagcggaggcgggggtagcggaggcgggggtagccaaatcacactgaaagagagcggccctacactcgtgaaacctacccagaccctgacactgacatgtaccttcagcggcttctccctgagcacctctggcgtcggcgttggatggatcagacagcctccaggcaaggccctggaatggctggctctgatctattggaacgacgacaagcggtacagccccagcctgaagtctagactgaccatcacaaaggacaccagcaagaaccaggtggtgctgaccatgacaaatatggaccccgtggacaccgccgtgtactactgcgccagagatgagtacggcggatttgatatctggggccagggcaccatggtgaccgtgtccagcaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 927 - DNA, 1461 bp, synthetic construct
  source 1..1461: mol_type = other DNA
atggctcttcccgtaacagcccttttgttgccccttgcactccttctgcatgcagcacgaccgcaagtgcagctcgtggaaagcggcggcggagtggtgcagcccggccggagcctgagactgtcctgcgccgcttctggatttaccttcagcagctacggcatgcactgggtcagacaggcccctggcaaaggcctggagtgggtggccgttatcagctacgagggcagcaacaagtattacgccgacagcgtgaagggccgcttcacaatctctagagataatagcaagaacaccctgtacctgcagatgaacagcctgcgggccgaagataccgccgtgtactactgtgctagagagctgggcgacggcatggacgtgtggggacagggcacaaccgtgaccgtgtcctctggtggtgggggcagcggtggaggtgggagcggaggcgggggtagcggaggcgggggtagcgagatcgtgctgacccagtcccctgctacactgagcctgtctccaggcgagcgggccacactgagctgtagagcttctcagagcgtgtccagctatctggcctggttccagcagaaacctggccaggcccctagactgctgatctacgacgccagcaaccgggccaccggcatccccgccagattcagcggctctggcagcggcaccgacttcaccctcaccatcagcagcctggaacccgaggattttgccgtctactactgccagcaaagagtggacctgtggaccttcggcggaggaacaaaggtggaaatcaagaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 928 - DNA, 1467 bp, synthetic construct
  source 1..1467: mol_type = other DNA
atggctcttcccgtaacagcccttttgttgccccttgcactccttctgcatgcagcacgaccggacatccagatgacccagagcccttcgaccctatccgcttccgtgggtgaccgtgtgaccatcacctgtcgcgcgtcgcagagcatctcctcctggctcgcgtggtaccaacagaagcctggcaaggcccccaagctgctgatttacgacgccagttccctggagtctggcgtgccatcccgcttctccggcagcggcagcggtaccgagttcaccctgacgatcagctccctgcagccggatgactttgctacctactactgtcagcaggtctcctccctcccccccaccttcggtggcggtaccaaggtggagatcaagggcggcggcggctctggtggcggaggttctggcgggggaggttcgggggggggaggctccgaggtgcaactggtagagagcggcgggggactggtaaaacccggcggctccctgcggctgtcatgcgctgctagcggcttcacgttcagcgattactacatgagttggatccgccaggcccccgggaagggtttggagtgggtctcgtatatctcttccagcggatctaccatttactatgcggacagcgtgaaggggcgcttcaccatatctcgggacaacgccaagaactccctgtacctgcagatgaattccctgcgtgccgaggacacggccgtgtattactgtgcccgcgaccagggcaactacggcgtcgacgtgtggggccagggtacaaccgtcaccgtgtccagtaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 929 - DNA, 1467 bp, synthetic construct
  source 1..1467: mol_type = other DNA
atggctcttcccgtaacagcccttttgttgccccttgcactccttctgcatgcagcacgaccgcaagtgcagctggtcgagagcggaggaggcctggttaagcccggcggatctctcagactgagctgcgccgctagcggctttacattcagcgactactacatgagctggatccggcaggcccctggcaagggcctggaatgggtgtcctacatcagctcctccggcagcaccatctactacgccgacagcgtgaaaggcagattcacaatctctagagataatgccaagaacagcctgtacctgcagatgaacagcctgcgggccgaggacaccgccgtgtactattgtgctagagatcagggcaactacggcgtggacgtgtggggccagggcaccaccgtgaccgtgtctagcggtggtgggggcagcggtggaggtgggagcggaggcgggggtagcggaggcgggggtagcgatatccagatgacccagtccccatctacactgagcgcctctgtgggcgaccgggtgaccattacatgtagagccagccagagcatcagcagctggctggcttggtatcagcagaaacctggcaaggcccctaagctgctgatctacgaggccagcagcctggaaagcggcgtccccagcagattcagcggcagcggctctggaacagagttcaccctgaccatctcctccctgcagcctgacgacttcgccacctactactgccagcaatctgatagccaccccatcacctttggcggaggcaccaaggtggaaatcaagaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 930 - DNA, 1467 bp, synthetic construct
  source 1..1467: mol_type = other DNA
atggctcttcccgtaacagcccttttgttgccccttgcactccttctgcatgcagcacgaccggatatccagatgacccagtccccatctacactgagcgcctctgtgggcgaccgggtgacaattacctgtagagctagccagagcatctcctcctggctggcttggtaccagcaaaaacctggcaaggcccctaagctgctgatctacgaggccagcagcctggaaagcggcgtcccctctagattcagcggcagcggctctggaaccgagttcaccctgacaatcagcagcctgcagcctgacgacttcgccacctattactgccagcaggccaacagccaccccatcacctttggcggaggcaccaaggtggaaatcaagggtggtgggggcagcggtggaggtgggagcggaggcgggggtagcggaggcgggggtagcgaggtgcagctggtggaaagcggcggaggactcgttaagcccggcggcagcctgagactgagctgcgccgctagcggatttaccttcagcgactactacatgagctggatccggcaggcccctggcaagggcctggaatgggtcagctacatcagctcctctggctctacaatctactacgccgacagcgtgaaaggcagattcaccatctctagagataatgccaagaacagcctgtacctgcaaatgaacagcctgcgggccgaggacaccgccgtgtactattgtgctagagatcagggcaactacggcgtggacgtgtggggccagggcaccaccgtgacagtgtcctccaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 931 - DNA, 1479 bp, synthetic construct
  source 1..1479: mol_type = other DNA
atggctcttcccgtaacagcccttttgttgccccttgcactccttctgcatgcagcacgaccggacatccagatgacccagagccctagctccctgagcgccagcgtgggcgatagagtgaccattacctgtagagcctctcagagcatctcctcctacctgaactggtatcagcagaaacccggcaaggcccctaagctgctgatctacgccgctagcagcctgcagtctggcgtccccagccggttcagcggcagcggatctggcaccgacttcaccctgacaatcagcagcctgcaacctgaggactttgctacatactactgccagcaggcccacagctctccaatcaccttcggcggcggaacaaaggtggaaatcaagggtggtgggggcagcggtggaggtgggagcggaggcgggggtagcggaggcgggggtagcgaggtgcagctgctggaaagcggaggcggactcgttcaacctggcggcagcctgagactgagctgcgccgcttctggatttaccttcagcaactacgccatgagctgggtgcggcaggcccctggcaaaggcctggaatgggtctccgccatcagcggctctggcggctccacctactacgccgacagcgtgaagggcagattcaccatctctagagataatagcaagaacaccctgtacctgcagatgaacagcctgcgggccgaggacaccgccgtgtactattgtgctagacccggagatggctactacgagggcgtgtacttcgactactggggccagggcacactggtgacagtgtccagcaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 932 - DNA, 1485 bp, synthetic construct
  source 1..1485: mol_type = other DNA
atggctcttcccgtaacagcccttttgttgccccttgcactccttctgcatgcagcacgaccggatattcagatgacccagagcccatctagcctgagcgccagcgtgggcgatagagtgaccatcacctgtcaggcctctcaggacatcgctaattacctgaactggtatcagcagaaacccggcaaggcccctaagctgctgatctacgacgcctccaacctggaaaccggcgtgcccagccggttcagcggcagcggatctggcacagacttcacctttaccatcagctccctccagcctgaggacatcgccacatactactgccagcaacacttcaacctgcctctgaccttcggcggcggaacaaaggtcgagatcaagggtggtgggggcagcggtggaggtgggagcggaggcgggggtagcggaggcgggggtagccaaatcaccctgaaagagagcggacctacactggtcaagcctacccagacactgaccctcacatgtacattcagcggctttagcctgagcacctccggcgtgggagtgggctggatcagacagccccccggcaaggccctggaatggctggctctgatctattggaatgacgagaagcggtacagccctagcctgaaatctagactgacaatcaccaaggacaccagcaagaaccaggtggtgctgaccatgaccaacatggatcctgtggataccgccgtgtactactgcgccagagaaggctctcacgactacaagagctccaactggttcgacccatggggccagggcaccctggttacagtgtctagcaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 933 - DNA, 1497 bp, synthetic construct
  source 1..1497: mol_type = other DNA
atggctcttcccgtaacagcccttttgttgccccttgcactccttctgcatgcagcacgaccggatatcgtgatgacccaatctccactgagcctgcctgtgacacctggcgagcctgcttctatcagctgtagaagcagccagtccctgctgcacagcaacggctacaactacctggactggtatctgcagaaacccggccagagcccccagctgctgatctacctcggctctaatcgggccagcggagtgcctgatagattcagcggaagcggctccggcaccgacttcaccctgaagatcagcagagtggaagccgaggacgtgggcgtctactactgcatgcaggccctgggcctgattacatttggcggcggaaccaaggtggaaatcaagggtggtgggggcagcggtggaggtgggagcggaggcgggggtagcggaggcgggggtagcgaagtgcagctggttgagagcggcggcggactggtgaagcccggaggcagcctcagactgagctgtgctgcttctggctttaccttcagctcttatagcatgaactgggtgcggcaggcccctggcaagggcctggaatgggtcagctccatcagctcttctagcagctacatctactacgccgacagcgtgaagggcagattcaccatcagcagagataacgccaagaacagcctgtacctgcagatgaatagcctgcgggccgaggacaccgccgtgtactactgcgccagagccggcgacacctacagcgccgccgattactactacatggacgtgtggggcaaaggaacaaccgtgacagtgtcctccaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 934 - DNA, 1080 bp, synthetic construct
  source 1..1080: mol_type = other DNA
atggctcttcccgtaacagcccttttgttgccccttgcactccttctgcatgcagcacgaccggaagtgcaactgctggaaagcggcggaggcctggtccagcccggcggctctctgcggctcagctgcgccgcttctggatttaccttcggcagcgaggctatgagctgggtgcggcaggcccctggaaaagagagagagctggtgtccgccatcagcggcagcggcgaggtgacctactacgccgacagcgtgaagggcagattcaccatctctagagataatagcaagaacaccctgtacctgcagatgaacagcctgagagccgaggacaccgccgtgtactattgtcagagactggtggaagccaagcggcactggggccagggcacacaggttacagtgtccagcaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 935 - DNA, 1080 bp, synthetic construct
  source 1..1080: mol_type = other DNA
atggctcttcccgtaacagcccttttgttgccccttgcactccttctgcatgcagcacgaccggaagtgcaactgctggaatctggcggaggactggtgcagcccggcggcagcctgcggctgagctgtgctgcttctggctttaccttcgagtctgaggccatgagctggtatagacaggcccctggcaaggaaagagagctggtcagcgtgatcaccagcgagggctccacctactacgccgacagcgtgaaaggcagattcacaatcagccgggacaatagcaagaacaccctgtacctgcagatgaacagcctgcgcgccgaagatacagccgtgtactactgcgcccacatcgagtgggagacaagactcaactggggccagggcacccaggtgaccgtgtccagcaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 936 - DNA, 1086 bp, synthetic construct
  source 1..1086: mol_type = other DNA
atggctcttcccgtaacagcccttttgttgccccttgcactccttctgcatgcagcacgaccggaggtgcagctgctggaaagcggagggggcctggtccaacccggcgggtctcttcgcctaagctgtgccgcttctggcttcaccttcgacgagtacaccatgcactggttcagacaggcccccggcaaggagcgcgagttcgtcagtgcaatcagcggaggcggtagcgagacttattacgcggactccgtgaagggccgcttcaccattagccgcgacaactccaagaacacgctgtacctgcagatgaattcgctgcgcgccgaagatacggccgtgtactactgtgccgctggtggggaggaggctggcgtgggctattggggccagggcacccaggtcaccgtgtcgtccaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 937 - DNA, 1092 bp, synthetic construct
  source 1..1092: mol_type = other DNA
atggctcttcccgtaacagcccttttgttgccccttgcactccttctgcatgcagcacgaccggaggtgcagctgctggagagcggaggcggcctcgtgcagccaggaggttccctacgactctcctgtgccgccagcggcttcaccttcgaggactacgccatgagttggttccgccaggccccggggaaggagcgcgagggcgtgagcgcgatttctggaaagggcggctccacctattacgcggactccgtgaagggtcgctttaccatctctcgcgacaactccaagaacacgctgtacctgcagatgaatagcctgcgcgctgaggacactgccgtgtactactgtgctgtcttggacgaggaggccggcgcagagggcggctattggggccagggtacccaggtcaccgtgtcgtccaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 938 - DNA, 1092 bp, synthetic construct
  source 1..1092: mol_type = other DNA
atggctcttcccgtaacagcccttttgttgccccttgcactccttctgcatgcagcacgaccggaggtgcaactgctggaaagcggcggtggactggtgcagcccggcggcagcctgagactgtcttgtgctgcttctggatttacattcgacagatacgccatgagctggttccgccaggcccctggcaaagagcgggaaggcgtgtccgccatctccacaagcggagatagcacatactatgccgacagcgtgaagggcagattcaccatcagcagagataatagcaagaacaccctgtacctgcagatgaacagcctccgggccgaggacaccgccgtctactactgcgccgtgctggacgaggaagccggcgccgagggcggctactggggccagggcacccaggtgaccgtgtctagcaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 939 - DNA, 1095 bp, synthetic construct
  source 1..1095: mol_type = other DNA
atggctcttcccgtaacagcccttttgttgccccttgcactccttctgcatgcagcacgaccggaggtgcaactgctggaaagcggcggaggactcgtccagcccggcggcagcctgcggctgagctgtgctgcttctggatttaccttcgccagcgacgccatgagctggtatagacaggcccctggcaaagagcgggaactggtgtccgccatcagcggctctggcggctccacctactacgccgatagcgtgaagggcagattcacaatctctagagataatagcaagaacaccctgtacctgcagatgaacagcctgagagccgaggacaccgccgtgtactactgcgccgctcacgacagcggcgaggcctacctggccttcgactactggggccagggcacacaggtgaccgtgtctagcaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 940 - DNA, 1095 bp, synthetic construct
  source 1..1095: mol_type = other DNA
atggctcttcccgtaacagcccttttgttgccccttgcactccttctgcatgcagcacgaccggaggtgcaactgctggaaagcggcggaggactcgtccagcccggcggcagcctgaggctgagctgtgctgcttctggctttaccttcgactcctacacaatgagctggtatagacaggcccctggcaaggagcgggaactggtgtccgccatcagcggccacggcgactctacatactacgccgacagcgtgaaaggcagattcacaatctctagagataatagcaagaacaccctgtacctgcagatgaacagcctgcgggccgaggacaccgccgtgtactactgcaccagaatcagcatcaccaccgagtggctggccggagattactggggccagggcacccaggtgacagtgtccagcaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 941 - DNA, 1101 bp, synthetic construct
  source 1..1101: mol_type = other DNA
atggctcttcccgtaacagcccttttgttgccccttgcactccttctgcatgcagcacgaccggaggtgcagctgctggaaagcggaggaggcctggtccaacctggcggcagcctgcggctgagctgcgccgcttctggcttcaccttcagcagctacgccatgagctggttccggcaggcccctggcaaggaaagagagttcgtgtcttttatcagcggatctggcgactccacctactacgctgatagcgtgaaaggcagatttaccatctctagagataatagcaagaacaccctgtacctccagatgaacagcctgcgcgccgaggacacagccgtgtactattgtaccagatggccttacgacttcgaggaaccaagcgagcccggcgtgtactggggccagggcacacaggtgacagtgtcctccaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 942 - DNA, 1101 bp, synthetic construct
  source 1..1101: mol_type = other DNA
atggctcttcccgtaacagcccttttgttgccccttgcactccttctgcatgcagcacgaccggaggtgcagctgctggaaagcggcggaggcctggtgcaacctggcggatctctcagactgagctgtgctgcttctggcttcacattcaccgactacgacatgagctggtatagacaggcccctggaaaagagcgggaactggtctccgtgatccacagcggcggctccacctactacgccgatagcgtgaagggcagattcaccatcagcagagataatagcaagaacaccctgtacctgcagatgaacagcctgcgggccgaggacaccgccgtgtactactgcgcccccggctactacagcgacctgtcttttgattattacaacttcgactactggggccagggcacacaggtgacagtgtccagcaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 943 - DNA, 1101 bp, synthetic construct
  source 1..1101: mol_type = other DNA
atggctcttcccgtaacagcccttttgttgccccttgcactccttctgcatgcagcacgaccggaggtgcagctgctggagagcggtggagggttggtgcagcccgggggtagcctgcgtctgtcgtgcgccgcttccggcttcacgttctctgattacgccatgcactggttccggcaggcccccggtaaggagcgcgtgctggtgtcgtctattgactccggcggctccacttactacgcagacagtgtcaagggccgtttcaccatcagccgcgacaacagcaagaacacgctgtacctgcagatgaactcccttcgagcagaggacaccgcggtgtactactgtaatgcgggcttcaagggcgatcacccccaccccaaggatgccttcgacatttggggccagggcacccaggtcaccgtgtcgtccaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 944 - DNA, 1107 bp, synthetic construct
  source 1..1107: mol_type = other DNA
atggctcttcccgtaacagcccttttgttgccccttgcactccttctgcatgcagcacgaccggaggtgcaactgctggaatccggcggaggcctggtgcagcccggcggcagcctcagactgagctgtgccgcttctggctttaccttcagcagcgagggcatgagctgggtgcggcaggcccctggcaaggaaagagagctggtctccgccatcagcggatctggcgaccacacctactatgccgatagcgtgcgcggaagattcacaatctctagagataatagcaagaacaccctgtacctgcagatgaacagcctgcgggccgaggacaccgccgtgtactactgcaacgccctggaaggcggccctacaacagctatccagccaggaggccctgactactggggccagggcacccaggtgaccgtgtccagcaccacaacacctgctccaaggccccccacacccgctccaactatagccagccaaccattgagcctcagacctgaagcttgcaggcccgcagcaggaggcgccgtccatacgcgaggcctggacttcgcgtgtgatatttatatttgggcacctttggccggaacatgtggggtgttgcttctctcccttgtgatcactctgtattgtaagcgcgggagaaagaagctcctgtacatcttcaagcagccttttatgcgacctgtgcaaaccactcaggaagaagatgggtgttcatgccgcttccccgaggaggaagaaggagggtgtgaactgagggtgaaattttctagaagcgccgatgctcccgcatatcagcagggtcagaatcagctctacaatgaattgaatctcggcaggcgagaagagtacgatgttctggacaaaagacggggcagggatcccgagatggggggaaagccccggagaaaaaatcctcaggaggggttgtacaatgagctgcagaaggacaagatggctgaagcctatagcgagatcggaatgaaaggcgaaagacgcagaggcaaggggcatgacggtctgtaccagggtctctctacagccaccaaggacacttatgatgcgttgcatatgcaagccttgccaccccgc

SEQ ID NO: 945 - DNA, 592 bp, synthetic construct
  source 1..592: mol_type = other DNA
aatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctg

SEQ ID NO: 946 - DNA, 592 bp, synthetic construct
  source 1..592: mol_type = other DNA
aatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaggtctgctgagactcggggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctg

SEQ ID NO: 947 - DNA, 389 bp, synthetic construct
  source 1..389: mol_type = other DNA
aatcaacctctggattacaaaatttgtgaaagattgactgatattcttaactatgttgctccttttacgctgtgtggatatgctgctttaatgcctctgtatcatgctattgcttcccgtacggctttcgttttctcctccttgtataaatcctggttgctgtctctttatgaggagttgtggcccgttgtccgtcaacgtggcgtggtgtgctctgtgtttgctgacgcaacccccactggctggggcattgccaccacctgtcaactcctttctgggactttcgctttccccctcccgatcgccacggcagaactcatcgccgcctgccttgcccgctgctggacaggggctaggttgctgggcactgataattccgtggtgttgtc

SEQ ID NO: 948 - DNA, 584 bp, synthetic construct
  source 1..584: mol_type = other DNA
gcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcg

SEQ ID NO: 949 - DNA, 1184 bp, synthetic construct
  source 1..1184: mol_type = other DNA
cgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 950 - DNA, 388 bp, synthetic construct
  source 1..388: mol_type = other DNA
aatgaaagaccccacctgtaggtttggcaagctaggatcaaggttaggaacagagagacagcagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggc

SEQ ID NO: 951 - DNA, 500 bp, synthetic construct
  source 1..500: mol_type = other DNA
gggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgtctcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcg

SEQ ID NO: 952 - DNA, 443 bp, synthetic construct
  source 1..443: mol_type = other DNA
tgaaagaccccacctgtaggtttggcaagatagctgcagtaacgccattttgcaaggcatggaaaaataccaaaccaagaatagagaagttcagatcaagggcgggtacatgaaaatagctaacgttgggccaaacaggatatctgcggtgagcagtttcggccccggcccggggccaagaacagatggtcaccgcagtttcggccccggcccgaggccaagaacagatggtccccagatatggcccaaccctcagcagtttcttaagacccatcagatgtttccaggctcccccaaggacctgaaatgaccctgcgccttatttgaattaaccaatcagcctgcttctcgcttctgttcgcgcgcttctgcttcccgagctctataaaagagctcacaacccctcactcggcgcgccagtcctccgattgactgagtcgccc

SEQ ID NO: 953 - DNA, 1212 bp, synthetic construct
  source 1..1212: mol_type = other DNA
ggcctccgcgccgggttttggcgcctcccgcgggcgcccccctcctcacggcgagcgctgccacgtcagacgaagggcgcagcgagcgtcctgatccttccgcccggacgctcaggacagcggcccgctgctcataagactcggccttagaaccccagtatcagcagaaggacattttaggacgggacttgggtgactctagggcactggttttctttccagagagcggaacaggcgaggaaaagtagtcccttctcggcgattctgcggagggatctccgtggggcggtgaacgccgatgattatataaggacgcgccgggtgtggcacagctagttccgtcgcagccgggatttgggtcgcggttcttgtttgtggatcgctgtgatcgtcacttggtgagtagcgggctgctgggctggccggggctttcgtggccgccgggccgctcggtgggacggaagcgtgtggagagaccgccaagggctgtagtctgggtccgcgagcaaggttgccctgaactgggggttggggggagcgcagcaaaatggcggctgttcccgagtcttgaatggaagacgcttgtgaggcgggctgtgaggtcgttgaaacaaggtggggggcatggtgggcggcaagaacccaaggtcttgaggccttcgctaatgcgggaaagctcttattcgggtgagatgggctggggcaccatctggggaccctgacgtgaagtttgtcactgactggagaactcggtttgtcgtctgttgcgggggcggcagttatggcggtgccgttgggcagtgcacccgtacctttgggagcgcgcgccctcgtcgtgtcgtgacgtcacccgttctgttggcttataatgcagggtggggccacctgccggtaggtgtgcggtaggcttttctccgtcgcaggacgcagggttcgggcctagggtaggctctcctgaatcgacaggcgccggacctctggtgaggggagggataagtgaggcgtcagtttctttggtcggttttatgtacctatcttcttaagtagctgaagctccggttttgaactatgcgctcggggttggcgagtgtgttttgtgaagttttttaggcaccttttgaaatgtaatcatttgggtcaatatgtaattttcagtgttagactagtaaattgtccgctaaattctggccgtttttggcttttttgttagac

SEQ ID NO: 954 - protein, 472 aa, synthetic construct
DIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGSTSGSGKPGSGEGSTKGQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSAAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 955 - protein, 467 aa, synthetic construct
QVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSSGGGGSEVQLVESGGGLVQAGGSLRLSCAASGRTFTMGWFRQAPGKEREFVAAISLSPTLAYYAESVKGRFTISRDNAKNTVVLQMNSLKPEDTALYYCAADRKSVMSIRPDYWGQGTQVTVSSTSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 956 - protein, 22 aa, synthetic construct
GSGATNFSLLKQAGDVEENPGP

SEQ ID NO: 957 - protein, 19 aa, synthetic construct
ATNFSLLKQAGDVEENPGP

SEQ ID NO: 958 - protein, 14 aa, synthetic construct
LLKQAGDVEENPGP

SEQ ID NO: 959 - protein, 21 aa, synthetic construct
GSGEGRGSLLTCGDVEENPGP

SEQ ID NO: 960 - protein, 18 aa, synthetic construct
EGRGSLLTCGDVEENPGP

SEQ ID NO: 961 - protein, 13 aa, synthetic construct
LLTCGDVEENPGP

SEQ ID NO: 962 - protein, 23 aa, synthetic construct
GSGQCTNYALLKLAGDVESNPGP

SEQ ID NO: 963 - protein, 20 aa, synthetic construct
QCTNYALLKLAGDVESNPGP

SEQ ID NO: 964 - protein, 14 aa, synthetic construct
LLKLAGDVESNPGP

SEQ ID NO: 965 - protein, 25 aa, synthetic construct
GSGVKQTLNFDLLKLAGDVESNPGP

SEQ ID NO: 966 - protein, 22 aa, synthetic construct
VKQTLNFDLLKLAGDVESNPGP

SEQ ID NO: 967 - protein, 19 aa, synthetic construct
LLNFDLLKLAGDVESNPGP

SEQ ID NO: 968 - protein, 19 aa, synthetic construct
TLNFDLLKLAGDVESNPGP

SEQ ID NO: 969 - protein, 17 aa, synthetic construct
NFDLLKLAGDVESNPGP

SEQ ID NO: 970 - protein, 20 aa, synthetic construct
QLLNFDLLKLAGDVESNPGP

SEQ ID NO: 971 - protein, 24 aa, synthetic construct
APVKQTLNFDLLKLAGDVESNPGP

SEQ ID NO: 972 - protein, 40 aa, synthetic construct
VTELLYRMKRAETYCPRPLLAIHPTEARHKQKIVAPVKQT

SEQ ID NO: 973 - protein, 18 aa, synthetic construct
LNFDLLKLAGDVESNPGP

SEQ ID NO: 974 - protein, 40 aa, synthetic construct
LLAIHPTEARHKQKIVAPVKQTLNFDLLKLAGDVESNPGP

SEQ ID NO: 975 - protein, 33 aa, synthetic construct
EARHKQKIVAPVKQTLNFDLLKLAGDVESNPGP

SEQ ID NO: 976 - protein, 10 aa, synthetic construct
GGGGSGGGGS

SEQ ID NO: 977 - protein, 15 aa, synthetic construct
GGGGSGGGGSGGGGS

SEQ ID NO: 978 - protein, 20 aa, synthetic construct
GGGGSGGGGSGGGGSGGGGS

SEQ ID NO: 979 - protein, 25 aa, synthetic construct
GGGGSGGGGSGGGGSGGGGSGGGGS

SEQ ID NO: 980 - DNA, 10 bp, synthetic construct
  source 1..10: mol_type = other DNA
gccrccatgg

What is claimed is:

1. An antibody or antigen binding fragment thereof comprising a heavy chain variable region (VH) comprising a CDRH1, a CDRH2, and a CDRH3 comprising the amino acid sequences set forth in SEQ ID NOs: 62, 63, and 64; a polypeptide linker; and a light chain variable region (VL) comprising a CDRL1, a CDRL2, and a CDRL3 comprising the amino acid sequences set forth in SEQ ID NOs: 66, 67, and 68.

2. The antibody or antigen binding fragment thereof of claim 1, wherein the polypeptide linker is selected from the

9. A chimeric antigen receptor (CAR) comprising the antibody or antigen binding fragment thereof of claim 1; a spacer domain; a transmembrane domain, and one or more intracellular signaling domains.

10. The CAR of claim 9, wherein:

(a) the spacer domain comprises a hinge domain or fragment thereof selected from the group consisting of: a CD4 hinge, a CD8β hinge, a CD8α hinge, a CD28 hinge, a CD134 hinge, a CD137 hinge, a CD152 hinge, a CD278 hinge, an IgG1 hinge, an IgG2 hinge, an IgG3 hinge, and an IgG4 hinge;

(b) the transmembrane domain is isolated or derived from a polypeptide selected from the group consisting of an alpha, beta, gamma, or delta chain of the T-cell receptor, CD3δ, CD3ε, CD3γ, CD3ζ, CD4, CD5, CD8α, CD9, CD16, CD22, CD27, CD28, CD33, CD37, CD45, CD64, CD80, CD86, CD134, CD137, CD152, CD154, CD278, amnionless (AMN), and programmed cell death 1 (PDCD1);

(c) the one or more intracellular signaling domains comprises a primary signaling domain isolated or derived from a polypeptide selected from the group consisting of FcRγ, FcRβ, CD3γ, CD3δ, CD3ε, CD3ζ, CD22, CD79a, CD79b, and CD66d; and (d) the one or more intracellular signaling domains comprises a costimulatory signaling domain isolated or derived from a polypeptide selected from the group consisting of TLR1, TLR2, TLR3, TLR4, TLR5, TLR6, TLR7, TLR8, TLR9, TLR10, CARD11, CD2, CD7, CD27, CD28, CD30, CD40, ICAM, CD83, CD94, CD134 (OX40), CD137 (4-1BB), CD278 (ICOS), DAP10, LAT, SLP76, TRAT1, TNFR2, TNFRS14, TNFRS18, TNFRS25, and ZAP70.

11. A CAR comprising:

(a) an antibody or antigen binding fragment thereof comprises the amino acid sequence set forth in SEQ ID NO: 69 or 70;

(b) a spacer domain comprising a hinge domain or fragment thereof selected from the group consisting of: a CD8α hinge, a CD28 hinge, and an IgG4 hinge;

(c) a transmembrane domain isolated from a polypeptide selected from the group consisting of: CD8α and CD28;

(d) one or more intracellular signaling domains comprising a costimulatory signaling domain isolated from a polypeptide selected from the group consisting of: CD28, CD137 (4-1BB), and CD278 (ICOS); and (e) a primary signaling domain isolated from CD35.

12. The CAR of claim 11, wherein the CAR comprises the amino acid sequence set forth in any one of SEQ ID NOs: 405, 406, 408, 409, 414, 415, 429, 430, 432, 433, 438, and 439.

13. A polynucleotide encoding the antibody or antigen binding fragment thereof of claim 1.

14. A polynucleotide encoding the CAR of claim 11.

15. A polynucleotide encoding the CAR of claim 12.

16. A polynucleotide encoding or comprising a promoter operably linked to a polynucleotide encoding the CAR of claim 11.

17. The polynucleotide of claim 16, wherein the promoter is a CAG promoter, an EF1α promoter, an MNDU3 promoter, a PGK1 promoter, an SFFV promoter, or a UBC promoter.

18. A DNA comprising a polynucleotide encoding the CAR of claim 11.

19. An RNA encoded by the DNA of claim 18.

20. A vector comprising a polynucleotide encoding the CAR of claim 11.

21. A vector encoding or comprising an MNDU3 or EF1α promoter operably linked to a polynucleotide encoding the CAR of claim 11.

22. The vector of claim 21, wherein the vector is a plasmid, transfer plasmid or viral vector.

23. The vector of claim 21, wherein the vector is a viral vector selected from the group consisting of an adenoviral (Ad) vector, an adeno-associated virus (AAV) vector, a herpes simplex virus (HSV) vector, a parvovirus vector, a rhabdovirus vector, a vesiculovirus vector, a paramyxovirus vector, a morbillovirus vector, a henipavirus vector, an alphavirus vector, a flavivirus vector, a retroviral vector, and a lentiviral vector (LVV).

24. The vector of claim 23, wherein the lentiviral vector is engineered or derived from the genome of a lentivirus selected from the group consisting of: HIV (HIV type 1 or HIV type 2); visna-maedi virus (VMV); caprine arthritis-encephalitis virus (CAEV); equine infectious anemia virus (EIAV); feline immunodeficiency virus (FIV); bovine immune deficiency virus (BIV); and simian immunodeficiency virus (SIV).

25. A lentiviral vector comprising: a 5' long terminal repeat (LTR) comprising R and U5 regions; a Psi (Ψ) packaging signal; a cPPT/FLAP; an export element; a polynucleotide encoding or comprising a promoter operably linked to the polynucleotide encoding a signal peptide and the CAR of claim 11; a 3' LTR comprising U3 and R regions; a polyadenylation signal, and a poly(A) tail.

26. A recombinant lentivirus comprising one or more copies of the lentiviral vector of claim 25.

27. A composition comprising the recombinant lentivirus of claim 26.

28. An RNA comprising: a 5' long terminal repeat (LTR) comprising R and U5 regions; a Psi (Ψ) packaging signal; a cPPT/FLAP; an export element; a polynucleotide encoding a promoter operably linked to a polynucleotide encoding a signal peptide and the CAR of claim 11; a 3' LTR comprising U3 and R regions; a polyadenylation signal, and a poly(A) tail.

29. A recombinant lentivirus comprising one or more copies of the RNA of claim 28.

30. A composition comprising the recombinant lentivirus of claim 29.

* * * * *